US007112668B2

(12) United States Patent
Rastelli et al.

(10) Patent No.: US 7,112,668 B2
(45) Date of Patent: Sep. 26, 2006

(54) POLYPEPTIDES AND NUCLEIC ACIDS ENCODED THEREBY

(75) Inventors: Luca Rastelli, Guilford, CT (US); Xiaojia (Sasha) Guo, Branford, CT (US)

(73) Assignee: CuraGen Corporation, Branford, CT (US)

( * ) Notice: Subject to any disclaimer, the term of this patent is extended or adjusted under 35 U.S.C. 154(b) by 331 days.

(21) Appl. No.: 10/055,877

(22) Filed: Jan. 22, 2002

(65) Prior Publication Data

US 2005/0288241 A1    Dec. 29, 2005

Related U.S. Application Data

(60) Provisional application No. 60/334,198, filed on Nov. 29, 2001, provisional application No. 60/330,227, filed on Oct. 18, 2001, provisional application No. 60/312,937, filed on Aug. 16, 2001, provisional application No. 60/311,975, filed on Aug. 13, 2001, provisional application No. 60/311,289, filed on Aug. 9, 2001, provisional application No. 60/304,886, filed on Jul. 12, 2001, provisional application No. 60/304,355, filed on Jul. 10, 2001, provisional application No. 60/304,353, filed on Jul. 10, 2001, provisional application No. 60/296,960, filed on Aug. 8, 2001, provisional application No. 60/291,701, filed on May 17, 2001, provisional application No. 60/287,484, filed on Apr. 30, 2001, provisional application No. 60/285,141, filed on Apr. 20, 2001, provisional application No. 60/285,140, filed on Apr. 20, 2001, provisional application No. 60/279,857, filed on Mar. 29, 2001, provisional application No. 60/278,151, filed on Mar. 23, 2001, provisional application No. 60/277,358, filed on Mar. 20, 2001, provisional application No. 60/276,449, filed on Mar. 15, 2001, provisional application No. 60/275,927, filed on Mar. 14, 2001, provisional application No. 60/275,990, filed on Mar. 14, 2001, provisional application No. 60/272,870, filed on Mar. 2, 2001, provisional application No. 60/263,351, filed on Jan. 30, 2001, provisional application No. 60/264,478, filed on Jan. 26, 2001, provisional application No. 60/264,139, filed on Jan. 25, 2001, provisional application No. 60/264,117, filed on Jan. 25, 2001, provisional application No. 60/263,799, filed on Jan. 24, 2001, provisional application No. 60/263,598, filed on Jan. 23, 2001, provisional application No. 60/262,892, filed on Jan. 19, 2001.

(51) Int. Cl.
C07H 21/02   (2006.01)
C07H 21/04   (2006.01)
C07K 14/435  (2006.01)

(52) U.S. Cl. ..................... 536/23.5; 530/395
(58) Field of Classification Search .............. 536/23.5; 530/395; 514/44
See application file for complete search history.

(56) References Cited

FOREIGN PATENT DOCUMENTS

WO    WO 92/05254    4/1992
WO    WO 02/055704   7/2002

OTHER PUBLICATIONS

Meinkoth et al. Hybridization of nucleic acids immobilized on solid supports. Analytical Biochemistry. 1984. vol. 138, pp. 267-284.*
Nakayama et al. Identification of high-molecular-weight proteins with multiple EGF-like motifs by motif-trap screening. Genomics. 1998. vol. 51, pp. 27-34.*
Berkemeier, et al. (1992). Som Cell Mol Genet 18: 233-245.
International Search Report for PCT/US 02/02064, mailed Mar. 13, 2002.
Ip, et al. (1992). Proc Natl Acad Sci USA 89: 3060-3064.
Agou, et al. (1999). "Single strand DNA specificity analysis of human nucleoside diphosphate kinase B." *J Biol Chem* 274(28): 19630-8.
Alderborn, et al. (2000). "Determination of single-nucleotide polymorphisms by real-time pyrophosphate DNA sequencing." *Genome Res* 10(8): 1249-58.
Ben-Arie, et al. (1994). "Olfactory receptor gene cluster on human chromosome 17: possible duplication of an ancestral receptor repertoire." *Hum Mol Genet* 3(2): 229-35.
Biggs, et al. (1990). "A Drosophila gene that is homologous to a mammalian gene associated with tumor metastasis codes for a nucleoside diphosphate kinase." *Cell* 63(5): 933-40.
Bissonnette, et al. (1999). "Functional expression of tagged human Na+-glucose cotransporter in Xenopus laevis oocytes." *J Physiol* 520 Pt 2: 359-71.
Blanke, et al. (1993). "N-terminal fragments of intestinal cholecystokinin: evidence for release of CCK-8 by cleavage on the carboxyl side of Arg74 of proCCK." *Regul Pept* 46(3): 575-82.
Blier (2001). "Pharmacology of rapid-onset antidepressant treatment strategies." *J Clin Psychiatry* 62(Suppl 15): 12-7.
Bodnar, et al. (1993). "Nuclear complementation restores mtDNA levels in cultured cells from a patient with mtDNA depletion." *Am J Hum Genet* 53(3): 663-9.
Chanoki, et al. (1995). "Increased expression of lysyl oxidase in skin with scleroderma." *Br J Dermatol* 133(5): 710-5.
Clayton, et al. (1986). "Mitochondrial phosphoenolpyruvate carboxykinase deficiency." *Eur J Pediatr* 145(1-2): 46-50.
Colombatti, et al. (2001). "Human MBP-specific T cells regulate IL-6 gene expression in astrocytes through cell—cell contacts and soluble factors." *Glia* 35(3): 224-33.

(Continued)

*Primary Examiner*—Marjorie A. Moran
(74) *Attorney, Agent, or Firm*—Mei L. Benni; George M. Yahwak

(57) ABSTRACT

Disclosed are novel polypeptides and nucleic acids encoding same. Also disclosed are vectors, host cells, antibodies and recombinant methods for producing the polypeptides and polynucleotides, as well as methods for using same.

7 Claims, No Drawings

OTHER PUBLICATIONS

Csiszar (2001). "Lysyl oxidases: a novel multifunctional amine oxidase family." *Prog Nucleic Acid Res Mol Biol* 70: 1-32.
Edgar (1995). "Hucolin, a new corticosteroid-binding protein from human plasma with structural similarities to ficolins. transforming growth factor-beta 1-binding proteins." *FEBS Lett* 375(1-2): 159-61.
El Yacoubi, et al. (2001). "Adenosine A2A receptor antagonists are potential antidepressants: evidence based on pharmacology and A2A receptor knockout mice." *Br J Pharmacol* 134(1); 68-77.
Endo, et al. (1996). "Cloning and characterization of the human lectin P35 gene and its related gene." *Genomics* 36(3): 515-21.
Faries, et al. (2001). "Calcium signaling inhibits interleukin-12 production and activates CD83(+) dendritic cells that induce Th2 cell development." *Blood* 98(8); 2489-97.
Fiser, et al. (1974). "Insulin-glucagon substrate interrelationships in the neonatal sheep." *Am J Obstet Gynecol* 120(7): 944-50.
GenBank Accession No.: A57713 (Mar. 3, 1998).
GenBank Accession No.: AAA66065 (May 10, 1995).
GenBank Accession No.: AAC70004 (May 17, 2000).
GenBank Accession No.: AAF17249 (Jan. 28, 2002).
GenBank Accession No.: AAG17167 (Aug. 10, 2001).
GenBank Accession No.: AAG41678 (Dec. 20, 2000).
GenBank Accession No.: AAG42364 (Dec. 26, 2000).
GenBank Accession No.: AAH01454 (Jul. 12, 2001).
GenBank Accession No.: AAH10318 (Oct. 22, 2001).
GenBank Accession No.: AAH17968 (Dec. 6, 2001).
GenBank Accession No.: AAH19978 (Jan. 22, 2002).
GenBank Accession No.: AAK97053 (Sep. 2, 2001).
GenBank Accession No.: AAL35774 (Apr. 8, 2002).
GenBank Accession No.: AAL35775 (Apr. 8, 2002).
GenBank Accession No.: AAL35776 (Apr. 8, 2002).
GenBank Accession No.: AB008225 (Jun. 5,1999).
GenBank Accession No.: AB009697 (Feb. 16, 1999).
GenBank Accession No.: AB011532 (Aug. 22, 1998).
GenBank Accession No.: AB011539 (Aug. 22, 1998).
GenBank Accession No.: AB030499 (Dec. 10, 1999).
GenBank Accession No.: AB047324 (May 16, 2001).
GenBank Accession No.: AB067483 (Sep. 15, 2001).
GenBank Accession No.: AF034693 (Jul. 22, 1998).
GenBank Accession No.: AF057039 (May 17, 2000).
GenBank Accession No.: AF097491 (Mar. 9, 1999).
GenBank Accession No.: AF101730 (Oct. 21, 1999).
GenBank Accession No.: AF116652 (May 8, 2001).
GenBank Accession No.: AF123303 (Feb. 1, 2000).
GenBank Accession No.: AF133300 (Dec. 20, 2000).
GenBank Accession No.: AF190274 (Oct. 6, 1999).
GenBank Accession No.: AF190500 (Aug. 10, 2001).
GenBank Accession No.: AF208031 (Jan. 28, 2002).
GenBank Accession No.: AF289204 (Dec. 26, 2000).
GenBank Accession No.: AF292385 (Sep. 2, 2001).
GenBank Accession No.: AJ006529 (Jul. 23, 1999).
GenBank Accession No.: AJ007973 (Feb. 9, 1999).
GenBank Accession No.: AJ133424 (Sep. 9, 1999).
GenBank Accession No.: AJ133426 (Sep. 9, 1999).
GenBank Accession No.: AJ242871 (Jan. 7, 2000).
GenBank Accession No.: AK054901 (Oct. 31, 2001).
GenBank Accession No.: AK057946 (Oct. 31, 2001).
GenBank Accession No.: AL109659 (Jul. 29, 2000).
GenBank Accession No.: AL133087 (Feb. 18, 2000).
GenBank Accession No.: AL359846 (Dec. 16, 2000).
GenBank Accession No.: AL450426 (Aug. 17, 2001).
GenBank Accession No.: AR035954 (Sep. 29, 1999).
GenBank Accession No.: AX083139 (Feb. 28, 2001).
GenBank Accession No.: B47172 (Oct. 20, 1997).
GenBank Accession No.: B56011 (Nov. 11, 1997).
GenBank Accession No.: BAA03753 (Feb. 4, 1999).
GenBank Accession No.: BAA09707 (Apr. 14, 2000).
GenBank Accession No.: BAA22950 (Jun. 5, 1999).
GenBank Accession No.: BAA75072 (Feb. 16, 1999).
GenBank Accession No.: BAB55595 (May 16, 2001).
GenBank Accession No.: BAB67789 (Sep. 15, 2001).
GenBank Accession No.: BAB70825 (Oct. 31, 2001).
GenBank Accession No.: BAB71619 (Oct. 31, 2001).
GenBank Accession No.: BC001454 (Jul. 12, 2001).
GenBank Accession No.: BC010318 (Oct. 22, 2001).
GenBank Accession No.: BC019978 (Jan. 22, 2002).
GenBank Accession No.: CAA03377 (Mar. 10, 1997).
GenBank Accession No.: CAA03380 (Mar. 10, 1997).
GenBank Accession No.: CAA03381 (Mar. 10, 1997).
GenBank Accession No.: CAB09724 (Dec. 11, 1997).
GenBank Accession No.: CAC00574 (Jul. 29, 2000).
GenBank Accession No.: CAC38938 (May 15, 2001).
GenBank Accession No.: CAC39840 (May 30, 2001).
GenBank Accession No.: CAC44547 (Jul. 19, 2001).
GenBank Accession No.: D16226 (Feb. 4, 1999).
GenBank Accession No.: D49355 (Feb. 10, 1999).
GenBank Accession No.: D63394 (Apr. 14, 2000).
GenBank Accession No.: D83920 (Feb. 6, 1999).
GenBank Accession No.: E30218 (Feb. 7, 2001).
GenBank Accession No.: JC4942 (Oct. 8, 1999).
GenBank Accession No.: JN0836 (May 7, 1999).
GenBank Accession No.: L16785 (Jan. 8, 1995).
GenBank Accession No.: M33987 (Oct. 31, 1994).
GenBank Accession No.: M35297 (Apr. 27, 1993).
GenBank Accession No.: M86529 (Apr. 27, 1993).
GenBank Accession No.: NM_002003 (Feb. 5, 2002).
GenBank Accession No.: NM_004563 (Dec. 10, 2001).
GenBank Accession No.: NM_017224 (Apr. 4, 2002).
GenBank Accession No.: NM_019474 (Jan. 7, 2002).
GenBank Accession No.: NM_019475 (Jan. 7, 2002).
GenBank Accession No.: Nm_024103 (Jul. 15, 2001).
GenBank Accession No.: NM_052944 (Dec. 20, 2001).
GenBank Accession No.: NM_053634 (Nov. 7, 2001).
GenBank Accession No.: NP_001994 (Feb. 5, 2002).
GenBank Accession No.: NP_004554 (Dec. 10, 2001).
GenBank Accession No.: NP_004781 (Apr. 8, 2002).
GenBank Accession No.: NP_058920 (Apr. 4, 2002).
GenBank Accession No.: NP_062347 (Jan. 7, 2002).
GenBank Accession No.: NP_062348 (Jan. 7, 2002).
GenBank Accession No.: NP_077008 (Jul. 15, 2001).
GenBank Accession No.: NP_443176 (Dec. 20, 2001).
GenBank Accession No.: NP_446086 (Nov. 7, 2001).
GenBank Accession No.: O00602 (Oct. 16, 2001).
GenBank Accession No.: O15084 (Oct. 16, 2001).
GenBank Accession No.: O60417 (Oct. 16, 2001).
GenBank Accession No.: O70324 (Oct. 16, 2001).
GenBank Accession No.: P00917 (Mar. 1, 2002).
GenBank Accession No.: P11532 (Mar. 1, 2002).
GenBank Accession No.: P15532 (Oct. 16, 2001).
GenBank Accession No.: P19804 (Oct. 16, 2001).
GenBank Accession No.: P22392 (Oct. 16, 2001).
GenBank Accession No.: P23749 (Jul. 1, 1993).
GenBank Accession No.: P24480 (Oct. 16, 2001).
GenBank Accession No.: P31949 (Oct. 16, 2001).
GenBank Accession No.: P34132 (Jun. 1, 1994).
GenBank Accession No.: P36021 (Oct. 16, 2001).
GenBank Accession No.: P46023 (Oct. 16, 2001).
GenBank Accession No.: P50543 (Oct. 16, 2001).
GenBank Accession No.: P51800 (Mar. 1, 2002).
GenBank Accession No.: P51801 (Mar. 1, 2002).
GenBank Accession No.: P51803 (Mar. 1, 2002).
GenBank Accession No.: P51804 (Mar. 1, 2002).
GenBank Accession No.: P53791 (Dec. 15, 1998).
GenBank Accession No.: P58182 (Oct. 16, 2001).
GenBank Accession No.: Q01768 (Jul. 15, 1999).
GenBank Accession No.: Q16822 (Mar. 1, 2002).
GenBank Accession No.: S48857 (Feb. 16, 1997).
GenBank Accession No.: S48858 (May 8, 1993).
GenBank Accession No.: S80990 (Mar. 27, 1997).
Gilles, et al. (1991). "Nucleoside diphosphate kinase from human erythrocytes. Structural characterization of the two polypeptide chains responsible for heterogeneity of the hexameric enzyme." *J Biol chem* 266(14): 8784-9.

Harumiya, et al. (1995). "EBP-37, a new elastin-binding protein in human plasma: structural similarity to ficolins, transforming growth factor-beta 1-binding proteins." *J Biochem* (Tokyo) 117(5): 1029-35.
Harumiya, et al. (1996). "Characterization of ficolins as novel elastin-binding proteins and molecular cloning of human ficolin-1." *J Biochem* (Tokyo) 120(4): 745-51.
Hommes, et al. 91976). "Two cases of phosphoenolpyruvate carboxykinase deficiency." *Acta Paediatr Scand* 65(2): 233-40.
Hoover, et al. (1998). "Loss of the tight junction MAGUK ZO-1 in breast cancer: relationship to glandular differentiation and loss of heterozygosity." *Am J Pathol* 153(6): 1767-73.
Ichijo, et al. (1991). "Purification of transforming growth factor-beta 1 binding proteins from porcine uterus membranes" *J Biol Chem* 266(33): 22459-64.
Irvin, et al. (2001). "Expression patterns of Notch1, Notch2, and Notch3 suggest multiple functional roles for the Notch-DSL signaling system during brain development." *J Comp Neurol* 436(2): 167-81.
Kovacs, et al. (1998). "Matching kinetics of synaptic vesicle recycling and enhanced neurotransmitter influx by Ca2+ in brain plasma membrane vesicles." *Neurochem Int* 33(5): 399-405.
Leonard, et al. (1991). "Mitochondrial phosphoenolpyruvate carboxykinase deficiency." *Eur J Pediatr* 150(3): 198-9.
L'Etoile, et al. (1994). "Human transcription factor IIIC box B binding subunit." *Proc Natl Acad sci U S A* 91(5): 1652-6.
Louahed, et al. (2000). "Interleukin-9 upregulates mucus expression in the airways." *Am J Respir Cell Mol Biol* 22(6): 649-56.
Lu, et al. (1996). "Human ficolin: cDNA cloning, demonstration of peripheral blood leucocytes as the major site of synthesis and assignment of the gene to chromosome 9." *Biochem J* 313(Pt 2): 473-8.
Lu, et al. (1996). "Biosynthesis of human ficolin, an Escherichia coli-binding protein, by monocytes: comparison with the synthesis of two macrophage-specific proteins, C1q and the mannose receptor." *Immunology* 89(2): 289-94.
Matsumoto, et al. (2000). "A novel carboxypeptidase B that processes native beta-amyloid precursor protein is present in human hippocampus." *Eur J Neurosci* 12(1): 227-38.
Matsushita, et al. (1996). "A novel human serum lectin with collagen- and fibrinogen-like domains that functions as an opsonin." *J Biol Chem* 271(5): 2448-54.
Modaressi, et al. (1996). "Molecular cloning, sequencing and expression of the cDNA of the mitochondrial form of phosphoenolpyruvate carboxykinase from human liver." *Biochem J* 315(Pt 3): 807-14.
Monopoli, et al. (1998). "Blockade of adenosine A2A receptors by SCH 58261 results in neuroprotective effects in cerebral ischaemia in rats." *Neuroreport* 9(17): 3955-9.
Ohashi and Erickson (1997). "Two oligomeric forms of plasma ficolin have differential lectin activity." *J Biol Chem* 272(22): 14220-6.
Online Mendelian Inheritance in Man (OMIM): 164342 (Jul. 6, 1993).
Orr, et al. (1979). "The heavy chain of human histocompatibility antigen HLA-B7 contains an immunoglobulin-like region." *Nature* 282(5736): 266-70.
Orskov, et al. (1989). "Carboxypeptidase-B-like processing of the C-terminus of glucagon-like peptide-2 in pig and human small intestine." *FEBS Lett* 247(2): 193-6.
Parkkila, et al. (2001). "Expression of membrane-associated carbonic anhydrase XIV on neurons and axons in mouse and human brain." *Proc Natl Acad Sci U S A* 98(4): 1918-23.
Pittenger, et al. (1999). "Multilineage potential of adult human mesenchymal stem cells." *Science* 284(5411): 143-7.
Reizer, et al. (1994). "A functional superfamily of sodium/solute symporters." *Biochim Biophys Acta* 1197(2): 133-66.
Shen, et al. (1996). "DNA binding domain and subunit interactions of transcription factor IIIC revealed by dissection with poliovirus 3C protease." *Mol Cell Biol* 16(8): 4163-71.
Sommer, et al. (1986). "Serum angiotensin-I-converting enzyme and carboxypeptidase N in Crohn's disease and ulcerative colitis." *Enzyme* 35(4): 181-8.
Sugiyama, et al. (2001). "Characterization of the efflux transport of 17beta-estradiol-D-17beta-glucuronide from the brain across the blood-brain barrier." *J Pharmacol Exp Ther* 298(1): 316-22.
Swall (SPTR) Accession No.: O01583 (Jul. 1, 1997).
Swall (SPTR) Accession No.: O14804 (Jan. 1, 1998).
Swall (SPTR) Accession No.: O43198 (Jun. 1, 1998).
Swall (SPTR) Accession No.: O43656 (Jun. 1, 1998).
Swall (SPTR) Accession No.: O44368 (Jun. 1, 1998).
Swall (SPTR) Accession No.: O54874 (Jun. 1, 1998).
Swall (SPTR) Accession No.: O54875 (Jun. 1, 1998).
Swall (SPTR) Accession No.: O54947 (Jun. 1, 1998).
Swall (SPTR) Accession No.: O57535 (Jun. 1, 1998).
Swall (SPTR) Accession No.: O73679 (Aug. 1, 1998).
Swall (SPTR) Accession No.: O73884 (Aug. 1, 1998).
Swall (SPTR) Accession No.: O75095 (Nov. 1, 1998).
Swall (SPTR) Accession No.: O75613 (Nov. 1, 1998).
Swall (SPTR) Accession No.: O88281 (Nov. 1, 1998).
Swall (SPTR) Accession No.: O88713 (Nov. 1, 1998).
Swall (SPTR) Accession No.: O95742 (May 1, 1999).
Swall (SPTR) Accession No.: Q02295 (Nov. 1, 1996).
Swall (SPTR) Accession No.: Q12789 (Nov. 1, 1996).
Swall (SPTR) Accession No.: Q12838 (Nov. 1, 1996).
Swall (SPTR) Accession No.: Q14205 (Nov. 1, 1996).
Swall (SPTR) Accession No.: Q28610 (Nov. 1, 1996).
Swall (SPTR) Accession No.: Q28728 (Nov. 1, 1996).
Swall (SPTR) Accession No.: Q63505 (Nov. 1, 1996).
Swall (SPTR) Accession No.: Q64335 (Nov. 1, 1996).
Swall (SPTR) Accession No.: Q90370 (Nov. 1, 1996).
Swall (SPTR) Accession No.: Q90888 (Nov. 1, 1996).
Swall (SPTR) Accession No.: Q91Y77 (Dec. 1, 2001).
Swall (SPTR) Accession No.: Q91ZB6 (Dec. 1, 2001).
Swall (SPTR) Accession No.: Q91ZZ5 (Dec. 1, 2001).
Swall (SPTR) Accession No.: Q92051 (Nov. 1, 1997).
Swall (SPTR) Accession No.: Q920P7 (Dec. 1, 2001).
Swall (SPTR) Accession No.: Q920P8 (Dec. 1, 2001).
Swall (SPTR) Accession No.: Q920Y8 (Dec. 1, 2001).
Swall (SPTR) Accession No.: Q920Y9 (Dec. 1, 2001).
Swall (SPTR) Accession No.: Q920Z0 (Dec. 1, 2000).
Swall (SPTR) Accession No.: Q923X5 (Dec. 1, 2001).
Swall (SPTR) Accession No.: Q923X8 (Dec. 1, 2001).
Swall (SPTR) Accession No.: Q923Y2 (Dec. 1, 2001).
Swall (SPTR) Accession No.: Q923Y6 (Dec. 1, 2001).
Swall (SPTR) Accession No.: Q924C6 (Dec. 1, 2001).
Swall (SPTR) Accession No.: Q92596 (Oct. 16, 2001).
Swall (SPTR) Accession No.: Q96AM1 (Dec. 1, 2001).
Swall (SPTR) Accession No.: Q96DY1 (Dec. 1, 2001).
Swall (SPTR) Accession No.: Q96E93 (Dec. 1, 2001).
Swall (SPTR) Accession No.: Q96JB6 (Dec. 1, 2001).
Swall (SPTR) Accession No.: Q96JB8 (Dec. 1, 2001).
Swall (SPTR) Accession No.: Q96K94 (Dec. 1, 2001).
Swall (SPTR) Accession No.: Q96KG6 (Dec. 1, 2001).
Swall (SPTR) Accession No.: Q96KG7 (Dec. 1, 2001).
Swall (SPTR) Accession No.: Q96PC0 (Dec. 1, 2001).
Swall (SPTR) Accession No.: Q96Q44 (Dec. 1, 2001).
Swall (SPTR) Accession No.: Q96RI9 (Dec. 1, 2001).
Swall (SPTR) Accession No.: Q98UK4 (Jun. 1, 2001).
Swall (SPTR) Accession No.: Q98UK5 (Jun. 1, 2001).
Swall (SPTR) Accession No.: Q9D6N1 (Jun. 1, 2001).
Swall (SPTR) Accession No.: Q9D9M5 (Jun. 1, 2000).
Swall (SPTR) Accession No.: Q9EQV9 (Mar. 1, 2001).
Swall (SPTR) Accession No.: Q9FZ62 (Mar. 1, 2001).
Swall (SPTR) Accession No.: Q9HBX9 (Mar. 1, 2001).
Swall (SPTR) Accession No.: Q9JHH6 (Oct. 1, 2000).
Swall (SPTR) Accession No.: Q9NCP8 (Oct. 1, 2000).
Swall (SPTR) Accession No.: Q9NQN1 (Oct. 16, 2001).
Swall (SPTR) Accession No.: Q9P1I2 (Oct. 1, 2000).
Swall (SPTR) Accession No.: Q9PUF2 (May 1, 2000).
Swall (SPTR) Accession No.: Q9QYH1 (May 1, 2000).
Swall (SPTR) Accession No.: Q9QZ19 (May 1, 2000).
Swall (SPTR) Accession No.: Q9QZ20 (May 1, 2000).
Swall (SPTR) Accession No.: Q9QZ21 (May 1, 2000).

Swall (SPTR) Accession No.: Q9QZ22 (May 1, 2000).
Swall (SPTR) Accession No.: Q9R1U7 (May 1, 2000).
Swall (SPTR) Accession No.: Q9SU92 (May 1, 2000).
Swall (SPTR) Accession No.: Q9TVQ2 (May 1, 2000).
Swall (SPTR) Accession No.: Q9UDP3 (Oct. 16, 2001).
Swall (SPTR) Accession No.: Q9UFA4 (May 1, 2000).
Swall (SPTR) Accession No.: Q9UGF7 (Oct. 16, 2001).
Swall (SPTR) Accession No.: Q9VBP0 (May 1, 2000).
Swall (SPTR) Accession No.: Q9VWF0 (May 1, 2000).
Swall (SPTR) Accession No.: Q9W1B0 (May 1, 2000).
Swall (SPTR) Accession No.: Q9W6N1 (Nov. 1, 1999).
Swall (SPTR) Accession No.: Q9Y4K0 (Oct. 16, 2001).
Swall (SPTR) Accession No.: Q9Y4W9 (Nov. 1, 1999).
Tanigaki, et al. (2001). "Notch1 and Notch 3 instructively restrict bFGF-responsive multipotent neural progenitor cells to an astroglial fate." *Neuron* 29(1): 45-55.

Teh, et al. (2000). "M-ficolin is expressed on monocytes and is a lectin binding to N-acetyl- D-glucosamine and mediates monocyte adhesion and phagocytosis of *Escherichia coli.*" *Immunology* 101(2): 225-32.

Tranquillini and Reggiani (1999). "Glycine-site antaginists and stroke." *Expert Opin Investig Drugs* 8(11): 1837-1848. Abstract Only.

Vidnes and Sovik (1976). "Gluconeogenesis in infancy and childhood. III. Deficiency of the extramitochondrial form of hepatic phosphoenolypruvate carboxykinase in a case of persistent neonatal hypoglycaemia." *Acta Paediatr Scand* 65(3): 307-12.

Wootton and Federhen (1996). "Analysis of compositionally biased regions in sequence databases." *Methods and Enzymol* 266: 554-71.

* cited by examiner

POLYPEPTIDES AND NUCLEIC ACIDS ENCODED THEREBY

RELATED APPLICATIONS

This application claims the benefit of U.S. Ser. No. 60/262,892, filed Jan. 19, 2001; U.S. Ser. No. 60/263,598, filed Jan. 23, 2001; U.S. Ser. No. 60/263,799, filed Jan. 24, 2001; U.S. Ser. No. 60/264,117, filed Jan. 25, 2001; U.S. Ser. No. 60/264,139, filed Jan. 25, 2001; U.S. Ser. No. 60/264,478, filed Jan. 26, 2001; U.S. Ser. No. 60/263,351, filed Jan. 30, 2001; U.S. Ser. No. 60/272,870, filed Mar. 2, 2001; U.S. Ser. No. 60/275,990, filed Mar. 14, 2001; U.S. Ser. No. 60/275,927, filed Mar. 14, 2001; U.S. Ser. No. 60/276,449, filed Mar. 15, 2001; U.S. Ser. No. 60/277,358, filed Mar. 20, 2001; U.S. Ser. No. 60/278,151, filed Mar. 23, 2001; U.S. Ser. No. 60/279,857, filed Mar. 29, 2001; U.S. Ser. No. 60/285,140, filed Apr. 20, 2001; U.S. Ser. No. 60/285,141, filed Apr. 20, 2001; U.S. Ser. No. 60/287,484, filed Apr. 30, 2001; U.S. Ser. No. 60/291,701, filed May 17, 2001; U.S. Ser. No. 60/296,960, filed Jun. 8, 2001; U.S. Ser. No. 60/304,353, filed Jul. 10, 2001; U.S. Ser. No. 60/304,355, filed Jul. 10, 2001; U.S. Ser. No. 60/304,886, filed Jul. 12, 2001; U.S. Ser. No. 60/311,289, filed Aug. 9, 2001; U.S. Ser. No. 60/311,975, filed Aug. 13, 2001; U.S. Ser. No. 60/312,937, filed Aug. 16, 2001; U.S. Ser. No. 60/330,227, filed Oct. 18, 2001; and U.S. Ser. No. 60/334,198, filed Nov. 29, 2001 each of which is incorporated by reference in its entirety.

The CD containing "CURA551.app" is herein incorporated by reference. This file was created on Jan. 28, 2003. It is 1.52 MB in size.

BACKGROUND OF THE INVENTION

The invention relates to polynucleotides and the polypeptides encoded by such polynucleotides, as well as vectors, host cells, antibodies and recombinant methods for producing the polypeptides and polynucleotides, as well as methods for using the same.

SUMMARY OF THE INVENTION

The invention is based in part upon the discovery of nucleic acid sequences encoding novel polypeptides. The novel nucleic acids and polypeptides are referred to herein as NOVX, or NOV1, NOV2, NOV3, NOV4, NOV5, NOV6, NOV7, NOV8, NOV9, NOV10, NOV11, NOV12, NOV13, NOV14, NOV15, NOV16, NOV17, NOV18, NOV19, NOV20, NOV21, NOV22, NOV23, NOV24, NOV25, NOV26, NOV27, NOV28, NOV29, NOV30, NOV31, NOV32, and NOV33 nucleic acids and polypeptides. These nucleic acids and polypeptides, as well as derivatives, homologs, analogs and fragments thereof, will hereinafter be collectively designated as "NOVX" nucleic acid or polypeptide sequences.

In one aspect, the invention provides an isolated NOVX nucleic acid molecule encoding a NOVX polypeptide that includes a nucleic acid sequence that has identity to the nucleic acids disclosed in SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 64, 66, 68, 70, 72, 74, 76, 78, 80, 82, 84, 86, 88, 90, 92, 94, 96, 98, 100, 102, 104, 106, 108, 110, 112, 114, 116, 118, 120, and 122. In some embodiments, the NOVX nucleic acid molecule will hybridize under stringent conditions to a nucleic acid sequence complementary to a nucleic acid molecule that includes a protein-coding sequence of a NOVX nucleic acid sequence.

The invention also includes an isolated nucleic acid that encodes a NOVX polypeptide, or a fragment, homolog, analog or derivative thereof. For example, the nucleic acid can encode a polypeptide at least 80% identical to a polypeptide comprising the amino acid sequences of SEQ ID NOS:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 65, 67, 69, 71, 73, 75, 77, 79, 81, 83, 85, 87, 89, 91, 93, 95, 97, 99, 101, 103, 105, 107, 109, 111, 113, 115, 117, 119, 121, and 123. The nucleic acid can be, for example, a genomic DNA fragment or a cDNA molecule that includes the nucleic acid sequence of any of SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 64, 66, 68, 70, 72, 74, 76, 78, 80, 82, 84, 86, 88, 90, 92, 94, 96, 98, 100, 102, 104, 106, 108, 110, 112, 114, 116, 118, 120, and 122.

Also included in the invention is an oligonucleotide, e.g., an oligonucleotide which includes at least 6 contiguous nucleotides of a NOVX nucleic acid (e.g., SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 64, 66, 68, 70, 72, 74, 76, 78, 80, 82, 84, 86, 88, 90, 92, 94, 96, 98, 100, 102, 104, 106, 108, 110, 112, 114, 116, 118, 120, and 122) or a complement of said oligonucleotide. Also included in the invention are substantially purified NOVX polypeptides (SEQ ID NOS:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 65, 67, 69, 71, 73, 75, 77, 79, 81, 83, 85, 87, 89, 91, 93, 95, 97, 99, 101, 103, 105, 107, 109, 111, 113, 115, 117, 119, 121, and 123). In certain embodiments, the NOVX polypeptides include an amino acid sequence that is substantially identical to the amino acid sequence of a human NOVX polypeptide.

The invention also features antibodies that immunoselectively bind to NOVX polypeptides, or fragments, homologs, analogs or derivatives thereof.

In another aspect, the invention includes pharmaceutical compositions that include therapeutically- or prophylactically-effective amounts of a therapeutic and a pharmaceutically acceptable carrier. The therapeutic can be, e.g., a NOVX nucleic acid, a NOVX polypeptide, or an antibody specific for a NOVX polypeptide. In a further aspect, the invention includes, in one or more containers, a therapeutically- or prophylactically-effective amount of this pharmaceutical composition.

In a further aspect, the invention includes a method of producing a polypeptide by culturing a cell that includes a NOVX nucleic acid, under conditions allowing for expression of the NOVX polypeptide encoded by the DNA. If desired, the NOVX polypeptide can then be recovered.

In another aspect, the invention includes a method of detecting the presence of a NOVX polypeptide in a sample. In the method, a sample is contacted with a compound that selectively binds to the polypeptide under conditions allowing for formation of a complex between the polypeptide and the compound. The complex is detected, if present, thereby identifying the NOVX polypeptide within the sample.

The invention also includes methods to identify specific cell or tissue types based on their expression of a NOVX.

Also included in the invention is a method of detecting the presence of a NOVX nucleic acid molecule in a sample by contacting the sample with a NOVX nucleic acid probe or primer, and detecting whether the nucleic acid probe or primer bound to a NOVX nucleic acid molecule in the sample.

In a further aspect, the invention provides a method for modulating the activity of a NOVX polypeptide by contacting a cell sample that includes the NOVX polypeptide with a compound that binds to the NOVX polypeptide in an amount sufficient to modulate the activity of said polypeptide. The compound can be, e.g., a small molecule, such as a nucleic acid, peptide, polypeptide, peptidomimetic, carbohydrate, lipid or other organic (carbon containing) or inorganic molecule, as further described herein.

Also within the scope of the invention is the use of a therapeutic in the manufacture of a medicament for treating or preventing disorders or syndromes including, e.g., trauma, regeneration (in vitro and in vivo), viral/bacterial/parasitic infections, Von Hippel-Lindau (VHL) syndrome, Alzheimer's disease, stroke, tuberous sclerosis, hypercalceimia, Parkinson's disease, Huntington's disease, cerebral palsy, epilepsy, Lesch-Nyhan syndrome, multiple sclerosis, ataxia-telangiectasia, leukodystrophies, behavioral disorders, addiction, anxiety, pain, actinic keratosis, acne, hair growth diseases, allopecia, pigmentation disorders, endocrine disorders, connective tissue disorders, such as severe neonatal Marfan syndrome, dominant ectopia lentis, familial ascending aortic aneurysm, inflammatory disorders such as osteo- and rheumatoid-arthritis, inflammatory bowel disease, Crohn's disease, immunological disorders, AIDS, cancers including but not limited to lung cancer, colon cancer, neoplasm, adenocarcinoma, lymphoma, prostate cancer, uterus cancer, leukemia or pancreatic cancer, blood disorders, asthma, psoriasis, vascular disorders, hypertension, skin disorders, renal disorders including Alport syndrome, immunological disorders, tissue injury, fibrosis disorders, bone diseases, osteogenesis imperfecta, Neurologic diseases, brain and/or autoimmune disorders like encephalomyelitis, neurodegenerative disorders, immune disorders, hematopoietic disorders, muscle disorders, inflammation and wound repair, bacterial, fungal, protozoal and viral infections (particularly infections caused by HIV-1 or HIV-2), pain, acute heart failure, hypotension, hypertension, urinary retention, osteoporosis, angina pectoris, myocardial infarction, ulcers, benign prostatic hypertrophy, arthrogryposis multiplex congenita, keratoconus, scoliosis, pancreatitis, obesity systemic lupus erythematosus, emphysema, scleroderma, allergy, ards, neuroprotection, fertility myasthenia gravis, diabetes, obesity, growth and reproductive disorders, hemophilia, hypercoagulation, immunodeficiencies, graft vesus host, congenital adrenal hyperplasia, endometriosis, xerostomia, ulcers, cirrhosis, transplantation, diverticular disease, hirschsprung's disease, appendicitis, tendinitis, renal artery stenosis, interstitial nephritis, glomerulonephritis, polycystic kidney disease, erythematosus, renal tubular acidosis, IgA nephropathy, anorexia, bulimia, psychotic disorders, including anxiety, schizophrenia, manic depression, delirium, dementia, severe mental retardation and dyskinesias, such as Huntington's disease and/or other pathologies and disorders of the like.

The therapeutic can be, e.g., a NOVX nucleic acid, a NOVX polypeptide, or a NOVX-specific antibody, or biologically-active derivatives or fragments thereof.

For example, the compositions of the present invention will have efficacy for treatment of patients suffering from the diseases and disorders disclosed above and/or other pathologies and disorders of the like. The polypeptides can be used as immunogens to produce antibodies specific for the invention, and as vaccines. They can also be used to screen for potential agonist and antagonist compounds. For example, a cDNA encoding NOVX may be useful in gene therapy, and NOVX may be useful when administered to a subject in need thereof. By way of non-limiting example, the compositions of the present invention will have efficacy for treatment of patients suffering from the diseases and disorders disclosed above and/or other pathologies and disorders of the like.

The invention further includes a method for screening for a modulator of disorders or syndromes including, e.g., the diseases and disorders disclosed above and/or other pathologies and disorders of the like. The method includes contacting a test compound with a NOVX polypeptide and determining if the test compound binds to said NOVX polypeptide. Binding of the test compound to the NOVX polypeptide indicates the test compound is a modulator of activity, or of latency or predisposition to the aforementioned disorders or syndromes.

Also within the scope of the invention is a method for screening for a modulator of activity, or of latency or predisposition to disorders or syndromes including, e.g., the diseases and disorders disclosed above and/or other pathologies and disorders of the like by administering a test compound to a test animal at increased risk for the aforementioned disorders or syndromes. The test animal expresses a recombinant polypeptide encoded by a NOVX nucleic acid. Expression or activity of NOVX polypeptide is then measured in the test animal, as is expression or activity of the protein in a control animal which recombinantly-expresses NOVX polypeptide and is not at increased risk for the disorder or syndrome. Next, the expression of NOVX polypeptide in both the test animal and the control animal is compared. A change in the activity of NOVX polypeptide in the test animal relative to the control animal indicates the test compound is a modulator of latency of the disorder or syndrome.

In yet another aspect, the invention includes a method for determining the presence of or predisposition to a disease associated with altered levels of a NOVX polypeptide, a NOVX nucleic acid, or both, in a subject (e.g., a human subject). The method includes measuring the amount of the NOVX polypeptide in a test sample from the subject and comparing the amount of the polypeptide in the test sample to the amount of the NOVX polypeptide present in a control sample. An alteration in the level of the NOVX polypeptide in the test sample as compared to the control sample indicates the presence of or predisposition to a disease in the subject. Preferably, the predisposition includes, e.g., the diseases and disorders disclosed above and/or other pathologies and disorders of the like. Also, the expression levels of the new polypeptides of the invention can be used in a method to screen for various cancers as well as to determine the stage of cancers.

In a further aspect, the invention includes a method of treating or preventing a pathological condition associated with a disorder in a mammal by administering to the subject a NOVX polypeptide, a NOVX nucleic acid, or a NOVX-specific antibody to a subject (e.g., a human subject), in an amount sufficient to alleviate or prevent the pathological condition. In preferred embodiments, the disorder, includes, e.g., the diseases and disorders disclosed above and/or other pathologies and disorders of the like.

In yet another aspect, the invention can be used in a method to identity the cellular receptors and downstream effectors of the invention by any one of a number of techniques commonly employed in the art. These include but are not limited to the two-hybrid system, affinity purification, co-precipitation with antibodies or other specific-interacting molecules.

NOVX nucleic acids and polypeptides are further useful in the generation of antibodies that bind immuno-specifically to the novel NOVX substances for use in therapeutic or diagnostic methods. These NOVX antibodies may be generated according to methods known in the art, using prediction from hydrophobicity charts, as described in the "Anti-NOVX Antibodies" section below. The disclosed NOVX proteins have multiple hydrophilic regions, each of which can be used as an immunogen. These NOVX proteins can be used in assay systems for functional analysis of various human disorders, which will help in understanding of pathology of the disease and development of new drug targets for various disorders.

The NOVX nucleic acids and proteins identified here may be useful in potential therapeutic applications implicated in (but not limited to) various pathologies and disorders as indicated below. The potential therapeutic applications for this invention include, but are not limited to: protein therapeutic, small molecule drug target, antibody target (therapeutic, diagnostic, drug targeting/cytotoxic antibody), diagnostic and/or prognostic marker, gene therapy (gene delivery/gene ablation), research tools, tissue regeneration in vivo and in vitro of all tissues and cell types composing (but not limited to) those defined here.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein are incorporated by reference in their entirety. In the case of conflict, the present specification, including definitions, will control. In addition, the materials, methods, and examples are illustrative only and not intended to be limiting.

Other features and advantages of the invention will be apparent from the following detailed description and claims.

DETAILED DESCRIPTION OF THE INVENTION

The present invention provides novel nucleotides and polypeptides encoded thereby. Included in the invention are the novel nucleic acid sequences and their encoded polypeptides. The sequences are collectively referred to herein as "NOVX nucleic acids" or "NOVX polynucleotides" and the corresponding encoded polypeptides are referred to as "NOVX polypeptides" or "NOVX proteins." Unless indicated otherwise, "NOVX" is meant to refer to any of the novel sequences disclosed herein. Table A provides a summary of the NOVX nucleic acids and their encoded polypeptides.

TABLE A

Sequences and Corresponding SEQ ID Numbers

| NOVX Assignment | Internal Identification | SEQ ID NO (nucleic acid) | SEQ ID NO (polypeptide) | Homology |
| --- | --- | --- | --- | --- |
| 1 | CG56181-01 | 1 | 2 | Neurotrophin-6 alpha |
| 2 | CG56275-01 | 3 | 4 | Guanylate kinase |
| 3 | CG53400-01 | 5 | 6 | 85.6 kDa protein |
| 4a | CG56209-01 | 7 | 8 | Myotonic dystrophy kinase-related CDC42-binding kinase |
| 4b | CG56209-02 | 9 | 10 | Myotonic dystrophy kinase-related CDC42-binding kinase |
| 5 | CG56288-01 | 11 | 12 | S100 Calcium binding protein |
| 6 | CG56048-01 | 13 | 14 | Olfactory receptor/GPCR |
| 7a | CG50365-01 | 15 | 16 | Carbonate dehydratase |
| 7b | CG50365-02 | 17 | 18 | Carbonate dehydratase |
| 8a | CG55794-01 | 19 | 20 | carboxypeptidase |
| 8b | CG55794-03 | 21 | 22 | carboxypeptidase |
| 8c | CG55794-06 | 23 | 24 | carboxypeptidase-B |
| 8d | CG55794-07 | 25 | 26 | carboxypeptidase-B |
| 9 | CG56463-01 | 27 | 28 | Neurotransmitter receptor |
| 10 | CG56321-01 | 29 | 30 | Proto-oncogene MAF |
| 11a | CG56381-01 | 31 | 32 | Lysyl oxidase |
| 11b | CG56381-02 | 33 | 34 | Lysyl oxidase |
| 12a | CG56436-01 | 35 | 36 | phosphatase |
| 12b | CG56436-02 | 37 | 38 | phosphatase |
| 13 | CG56441-01 | 39 | 40 | Chloride Channel protein CLC-KA |
| 14 | CG56442-01 | 41 | 42 | Mast cell function associated antigen (MAFA) |
| 15a | CG56449-01 | 43 | 44 | MEGF6 |
| 15b | CG56449-02 | 45 | 46 | MEGF6 |
| 15c | CG56449-03 | 47 | 48 | MEGF6 |
| 15d | CG56449-04 | 49 | 50 | MEGF6 |
| 15e | CG56449-06 | 51 | 52 | MEGF6 |
| 15f | CG56449-08 | 53 | 54 | MEGF6 |
| 16 | AL359846_A_da1 | 55 | 56 | GPCR |
| 17a | CG56459-01 | 57 | 58 | PEST-containing transporter |
| 17b | CG56459-02 | 59 | 60 | Na+ independent aromatic amino acid transporter |
| 18a | CG56510-01 | 61 | 62 | Olfactory receptor/GPCR |
| 18b | CG56510-02 | 63 | " | Olfactory receptor/GPCR |
| 19a | CG56574-01 | 64 | 65 | Major Duchenne muscular dystrophy protein (DP71) |
| 19b | CG56574-02 | 66 | 67 | Major Duchenne muscular dystrophy protein (DP71) |
| 20a | CG56517-01 | 68 | 69 | GPCR RTA |
| 20b | CG56517-02 | 70 | 71 | GPCR RTA |

TABLE A-continued

Sequences and Corresponding SEQ ID Numbers

| NOVX Assignment | Internal Identification | SEQ ID NO (nucleic acid) | SEQ ID NO (polypeptide) | Homology |
| --- | --- | --- | --- | --- |
| 21 | CG56500-01 | 72 | 73 | TFIIIC box B-binding subunit |
| 22 | CG56475-01 | 74 | 75 | Nucleosidediphosphate kinase B |
| 23 | CG56352-02 | 76 | 77 | T-cell |
| 24a | CG56062-01 | 78 | 79 | Organic anion transporter 3 |
| 24b | CG56062-01 | 80 | 81 | Renal organic anion transporter |
| 25a | 152736829 | 82 | 83 | Ficolin |
| 25b | CG56653-02 | 84 | 85 | Ficolin |
| 25c | CG56653-03 | 86 | 87 | Ficolin |
| 25d | CG56653-04 | 88 | 89 | Ficolin |
| 25e | CG56653-06 | 90 | 91 | Ficolin |
| 25f | CG56653-01 | 92 | 93 | Ficolin |
| 25g | CG56653-09 | 94 | 95 | Ficolin |
| 25h | 169319361 | 96 | 97 | Ficolin |
| 26 | 152736833 | 98 | 99 | Ficolin |
| 27 | CG56262-01 | 100 | 101 | Peroxisomal Ca-dependent solute carrier |
| 28 | CG56559-01 | 102 | 103 | Na+/glucose cotransporter |
| 29a | CG56557-01 | 104 | 105 | Na+/glucose cotransporter |
| 29b | CG56557-02 | 106 | 107 | Na+/glucose cotransporter |
| 29c | CG56557-03 | 108 | 109 | Na+/glucose cotransporter |
| 29d | CG56557-04 | 110 | 111 | Na+/glucose cotransporter |
| 29e | CG56557-05 | 112 | 113 | Na+/glucose cotransporter |
| 29f | CG56557-06 | 114 | 115 | Na+/glucose cotransporter |
| 30 | CG56398-01 | 116 | 117 | Na+/glucose cotransporter |
| 31 | CG56616-01 | 118 | 119 | Olfactory receptor/GPCR |
| 32 | 153065222 (or CG56234-02) | 120 | 121 | Phosphoenolpyruvate Carboxykinase |
| 33 | CG56610-01 | 122 | 123 | Olfactory receptor/GPCR |

NOVX nucleic acids and their encoded polypeptides are useful in a variety of applications and contexts. The various NOVX nucleic acids and polypeptides according to the invention are useful as novel members of the protein families according to the presence of domains and sequence relatedness to previously described proteins. Additionally, NOVX nucleic acids and polypeptides can also be used to identify proteins that are members of the family to which the NOVX polypeptides belong.

NOV1 is homologous to members of the neurotrophin-6 alpha family of proteins. Thus, the NOV1 nucleic acid and polypeptide, antibodies and related compounds according to the invention may be used to treat immune and nervous system disorders, e.g., proinflammatory disorder, immune disorder, inflammatory disease, septic shock, arthritis, bone pain, or bone deformity.

NOV2 is homologous to members of the guanylate kinase family of proteins. Thus, the NOV2 nucleic acid and polypeptide, antibodies and related compounds according to the invention will be useful in therapeutic and diagnostic applications in the mediation of biosynthesis and nucleotide metabolism. As such the NOV2 nucleic acid and polypeptide, antibodies and related compounds according to the invention may be used to treat genetic conditions, e.g., Von Hippel-Lindau (VHL) syndrome, diabetes, or tuberous sclerosis.

NOV3 is homologous to members of a family of the 85.6 kDa-like proteins that contain ankyrin domains. Thus NOV3 nucleic acid and polypeptide, antibodies and related compounds according to the invention will be useful in therapeutic and diagnostic applications in the mediation of signal transduction or cell activation. As such the NOV3 nucleic acid and polypeptide, antibodies and related compounds according to the invention may be used to treat genetic conditions, e.g., endometriosis, fertility, adrenoleukodystrophy, congenital adrenal hyperplasia, diabetes, Von Hippel-Lindau (vhl) syndrome, pancreatitis, obesity, hyperparathyroidism, hypoparathyroidism, hyperthyroidism, hypothyroidism, SIDS, xerostomia, scleroderma, hypercalceimia, ulcers, cirrhosis, transplantation, inflammatory bowel disease, diverticular disease, hirschsprung's disease, crohn's disease, appendicitis, hemophilia, hypercoagulation, idiopathic thrombocytopenic purpura, autoimmume disease, allergies, immunodeficiencies, graft vesus host, anemia, ataxia-telangiectasia, lymphedema, tonsilitis, osteoporosis, hypercalceimia, arthritis, ankylosing spondylitis, scoliosis, tendinitis, muscular dystrophy, lesch-nyhan syndrome, myasthenia gravis, dental disease and infection, cardiomyopathy, atherosclerosis, hypertension, congenital heart defects, aortic stenosis, atrial septal defect (asd), atrioventricular (a-v) canal defect, ductus arteriosus, pulmonary stenosis, subaortic stenosis, ventricular septal defect (vsd), valve diseases, tuberous sclerosis, aneurysm, fibromuscular dysplasia, stroke, bleeding disorders, alzheimer's disease, parkinson's disease, huntington's disease, cerebral palsy, epilepsy, multiple sclerosis, ataxia-telangiectasia, leukodystrophies, behavioral disorders, addiction, anxiety, pain, neuroprotection, endocrine dysfunctions, growth and reproductive disorders, cystitis, incontinence, renal artery stenosis, interstitial nephritis, glomerulonephritis, polycystic kidney disease, systemic lupus erythematosus, renal tubular acidosis, iga nephropathy, or vesicoureteral reflux.

NOV4 is homologous to members of the mytonic dystrophy kinase-related CDC42-binding kinase family of proteins. Thus, the NOV4 nucleic acids and polypeptides, antibodies and related compounds according to the invention may be used to treat muscle, or cell migration disorders, e.g., myotonic dystrophy, myotonic dystrophy type 2, proximal myotonic myopathy, proximal myotonic dystrophy, neuromuscular diseases associated with cardiomyopathy, multiple endocrine neoplasia type 1(MEN1), insulin dependent diabetes mellitus, familial paraganglioma type 2, spinocerebellar ataxia type 5, Bardet-Biedl syndrome, non-hodgkins lymphoma, cancers such as breast cancer, liver, lung, pancrease, and prostate cancers.

NOV5 is homologous tomembers of the S100 Calcium binding protein family. Thus, the NOV5 nucleic acid and polypeptide, antibodies and related compounds according to the invention may be used to treat genetic conditions, e.g., various cancers like breast, lung, and colorectal, as well as heart disease such as myocardial ischemia.

NOV6, NOV16, NOV18, NOV31, and NOV33 are homologous to the olfactory receptor/GPCR-like family of proteins. G-Protein Coupled Receptor (GPCRs) have been identified as an extremely large family of protein receptors in a number of species. Thus, the NOV6 nucleic acid and polypeptide, antibodies and related compounds according to the invention will be useful in therapeutic and diagnostic applications in the mediation of signal transduction. As such the NOV6 nucleic acid and polypeptide, antibodies and related compounds according to the invention may be used to treat, e.g., developmental diseases, MHC II and III diseases (immune diseases), taste and scent detectability disorders, Burkitt's lymphoma, corticoneurogenic disease, signal transduction pathway disorders, retinal diseases including those involving photoreception, cell growth rate disorders, cell shape disorders, feeding disorders, control of feeding, potential obesity due to over-eating, potential disorders due to starvation (lack of apetite), noninsulin-dependent diabetes mellitus (NIDDM1), bacterial, fungal, protozoal and viral infections (particularly infections caused by HIV-1 or HIV-2), pain, cancer (including but not limited to neoplasm, adenocarcinoma, lymphoma, prostate cancer, uterus cancer), anorexia, bulimia, asthma, parkinson's disease, acute heart failure, hypotension, hypertension, urinary retention, osteoporosis, crohn's disease, multiple sclerosis, and treatment of albright hereditary ostoeodystrophy, angina pectoris, myocardial infarction, ulcers, asthma, allergies, benign prostatic hypertrophy, and psychotic and neurological disorders, including anxiety, schizophrenia, manic depression, delirium, dementia, severe mental retardation, dentatorubro-pallidoluysian atrophy(DRPLA) hypophosphatemic rickets, autosomal dominant (2) acrocallosal syndrome and dyskinesias, such as huntington's disease or gilles de la tourette syndrome.

NOV7 is homologous to members of the carbonate dehydratase/anhydrase family of proteins. As such the NOV7 nucleic acids and polypeptides, antibodies and related compounds according to the invention may be used to treat respiratory or CO2 transport disorders, e.g., lung cancer, hypertension, asthma, emphysema, or diabetes.

NOV8 is homologous to members of the carboxypeptidase family of proteins. Thus, the NOV8 nucleic acids and polypeptides, antibodies and related compounds according to the invention may be used to treat digestive disorders, e.g., xerostomia, hypercalceimia, ulcers, Von Hippel-Lindau (VHL) syndrome, cirrhosis, transplantation, inflammatory bowel disease, diverticular disease, hirschsprung's disease, crohn's disease, appendicitis, stroke, tuberous sclerosis, anxiety, pain, endocrine dysfunctions, nueroprotection, diabetes, obesity, growth and reproductive disorders, myasthenia gravis.

NOV9 is homologous to members of the neurotransmitter receptor family of proteins. Thus, the NOV9 nucleic acid and polypeptide, antibodies and related compounds according to the invention may be used to treat, e.g., leukemia, acute nonlymphocytic, spinocerebellar ataxia-1, or neurological disorders.

NOV10 is homologous to members of the proto-oncogene MAF-like family of proteins. Thus, the NOV10 nucleic acid and polypeptide, antibodies and related compounds according to the invention may be used to treat, e.g., anemia, ataxia-telangiectasia, autoimmume disease, cancer, immunodeficiencies, hemophilia, hypercoagulation, idiopathic thrombocytopenic purpura, allergies, transplantation, graft versus host disease (GVHD), lymphaedema, systemic lupus erythematosus, asthma, emphysema, scleroderma, ARDS, diabetes, renal artery stenosis, interstitial nephritis, glomerulonephritis, polycystic kidney disease, systemic lupus erythematosus, renal tubular acidosis, IgA nephropathy, hypercalceimia, or Lesch-Nyhan syndrome.

NOV11 is homologous to members of the lysyl oxidase family of proteins. Thus, the NOV11 nucleic acids and polypeptides, antibodies and related compounds according to the invention may be used to treat digestive disorders, e.g., diabetes, Von Hippel-Lindau (VHL) syndrome, pancreatitis, obesity, endometriosis, fertility, hemophilia, hypercoagulation, idiopathic thrombocytopenic purpura, autoimmune disease, allergies, immunodeficiencies, transplantation, graft versus host disease (GVHD), lymphaedema, osteoporosis, hypercalceimia, arthritis, ankylosing spondylitis, scoliosis, systemic lupus erythematosus, asthma, emphysema, scleroderma, allergy, ARDS, renal artery stenosis, interstitial nephritis, glomerulonephritis, polycystic kidney disease, systemic lupus erythematosus, renal tubular acidosis, IgA nephropathy, Lesch-Nyhan syndrome, psoriasis, actinic keratosis, tuberous sclerosis, acne, hair growth/loss, allopecia, pigmentation disorders, and endocrine disorders.

NOV12 is homologous to members of the phosphatase family of proteins. Thus, the NOV12 nucleic acids and polypeptides, antibodies and related compounds according to the invention may be used to treat, e.g., hyperthyroidism, hypothyroidism, endometriosis, fertility, Von Hippel-Lindau (VHL) syndrome, cirrhosis, transplantation, hypogonadism, Alzheimer's disease, stroke, tuberous sclerosis, hypercalceimia, Parkinson's disease, Huntington's disease, cerebral palsy, epilepsy, Lesch-Nyhan syndrome, multiple sclerosis, ataxia-telangiectasia, leukodystrophies, behavioral disorders, addiction, anxiety, pain, neurodegeneration, endocrine dysfunctions, diabetes, obesity, growth and reproductive disorders, systemic lupus erythematosus, autoimmune disease, asthma, emphysema, scleroderma, allergy, ARDS, renal artery stenosis, interstitial nephritis, glomerulonephritis, polycystic kidney disease, renal tubular acidosis, IgA nephropathy, hemophilia, hypercoagulation, idiopathic thrombocytopenic purpura, immunodeficiencies, and graft versus host disease.

NOV13 is homologous to members of the chloride channel CLC-KA family of proteins. Thus, the NOV13 nucleic acid and polypeptide, antibodies and related compounds according to the invention may be used to treat, e.g., diabetes, autoimmune disease, renal artery stenosis, interstitial nephritis, glomerulonephritis, polycystic kidney disease, systemic lupus erythematosus, renal tubular acidosis, IgA nephropathy, hypercalceimia, or Lesch-Nyhan syndrome.

NOV14 is homologous to members of the mast cell function-associated antigen (MAFA) family of proteins. Thus, the NOV14 nucleic acid and polypeptide, antibodies and related compounds according to the invention may be used to treat, e.g., cancer, autoimmune disease, allergies, immunodeficiencies, transplantation, graft versus host disease (GVHD), or lymphaedema.

NOV15 is homologous to members of the murine epithelial growth factor (MEGF) family of proteins. Thus, the NOV15 nucleic acids and polypeptides, antibodies and related compounds according to the invention may be used to treat, e.g., cancer, trauma, bacterial and viral infections, regeneration (in vitro and in vivo), fertility, endometriosis, cardiomyopathy, atherosclerosis, hypertension, congenital heart defects, aortic stenosis, atrial septal defect (ASD), atrioventricular (A-V) canal defect, ductus arteriosus, pulmonary stenosis, subaortic stenosis, ventricular septal defect (VSD), valve diseases, tuberous sclerosis, scleroderma, obesity, transplantation, anemia, bleeding disorders, transplantation, diabetes, autoimmune disease, renal artery stenosis, interstitial nephritis, glomerulonephritis, polycystic kidney disease, systemic lupus erythematosus, renal tubular acidosis, IgA nephropathy, hypercalceimia, Lesch-Nyhan syndrome, systemic lupus erythematosus, autoimmune disease, asthma, emphysema, allergy, ARDS, von Hippel-Lindau (VHL) syndrome, Alzheimer's disease, stroke, hypercalceimia, Parkinson's disease, Huntington's disease, cerebral palsy, epilepsy, Lesch-Nyhan syndrome, multiple sclerosis, ataxia-telangiectasia, leukodystrophies, behavioral disorders, addiction, anxiety, pain, neurodegeneration, Hirschsprung's disease, Crohn's Disease, and appendicitis.

NOV17 is homologous to members of the monocarboxylate transporter (MCT)-like family of proteins. Thus, the NOV17 nucleic acids and polypeptides, antibodies and related compounds according to the invention may be used to treat, e.g., Salla disease, infantile sialic acid storage disease, cystinosis, or streptozotocin-induced diabetes.

NOV19 is homologous to members of the major Duchenne muscular dystrophy (DP71) family of proteins. Thus, the NOV19 nucleic acids and polypeptides, antibodies and related compounds according to the invention may be used to treat muscle and nervous system disorders, e.g., Duchenne muscular dystrophy, Becker muscular dystroph, cardiomyopathy, dilated, X-linked, McLeod phenotype, Lesch-Nyhan syndrome, myasthenia gravis.

NOV20 is homologous to members of the GPCR RTA family of proteins. Thus, the NOV20 nucleic acids and polypeptides, antibodies and related compounds according to the invention may be used to treat a wide range of disorders such as cancer, immune disorders, endocrine disorders and other diseases, e.g., developmental diseases; MHCII and III diseases (immune diseases); taste and scent detectability disorders; Burkitt's lymphoma; corticoneurogenic disease; signal transduction pathway disorders; metabolic pathway disorders; retinal diseases including those involving photoreception; cell growth rate disorders; cell shape disorders; metabolic disorders; feeding disorders; control of feeding; the metabolic syndrome X; wasting disorders associated with chronic diseases; obesity; potential obesity due to over-eating or metabolic disturbances; potential disorders due to starvation (lack of appetite); diabetes; noninsulin-dependent diabetes mellitus (NIDDM); infectious disease; bacterial, fungal, protozoal and viral infections (particularly infections caused by HIV-1 or HIV-2); pain; cancer (including but not limited to neoplasm; adenocarcinoma; lymphoma; prostate cancer; uterus cancer); cancer-associated cachexia; anorexia; bulimia; asthma; Parkinson's disease; acute heart failure; hypotension; hypertension; urinary retention; osteoporosis; Crohn's disease; multiple sclerosis; Albright Hereditary Ostoeodystrophy; angina pectoris; myocardial infarction; ulcers; allergies; benign prostatic hypertrophy; and psychotic and neurological disorders; including anxiety; schizophrenia; manic depression; delirium; dementia; neurodegenerative disorders; Alzheimer's disease; severe mental retardation; Dentatorubro-pallidoluysian atrophy (DRPLA); Hypophosphatemic rickets; autosomal dominant (2) Acrocallosal syndrome and dyskinesias, such as Huntington's disease or Gilles de la Tourette syndrome; immune disorders; Adrenoleukodystrophy; Congenital Adrenal Hyperplasia; Hemophilia; Hypercoagulation; Idiopathic thrombocytopenic purpura; autoimmume disease; immunodeficiencies; transplantation; Von Hippel-Lindau (VHL) syndrome; Stroke; Tuberous sclerosis; hypercalceimia; Cerebral palsy; Epilepsy; Lesch-Nyhan syndrome; Ataxia-telangiectasia; Leukodystrophies; Behavioral disorders; Addiction; Neuroprotection; Cirrhosis; Transplantation; Systemic lupus erythematosus; Emphysema; Scleroderma; ARDS; Renal artery stenosis; Interstitial nephritis; Glomerulonephritis; Polycystic kidney disease; Systemic lupus erythematosus; Renal tubular acidosis; IgA nephropathy; Cardiomyopathy; Atherosclerosis; Congenital heart defects; Aortic stenosis; Atrial septal defect (ASD); Atrioventricular (A-V) canal defect; Ductus arteriosus; Pulmonary stenosis; Subaortic stenosis; Ventricular septal defect (VSD); valve diseases; Scleroderma; fertility; Pancreatitis; Endocrine dysfunctions; Growth and reproductive disorders; Inflammatory bowel disease; Diverticular disease; Leukodystrophies; Graft vesus host; Hyperthyroidism; Endometriosis; and hematopoietic disorders.

NOV21 is homologous to members of the TFIIIC box B-binding subunit family of proteins. Thus, the NOV21 nucleic acids and polypeptides, antibodies and related compounds according to the invention may be used to treat cancer and viral infections, e.g., TFIIIC box B-binding subunit protein is cleaved and inactivated by the poliovirus-encoded 3C protease during poliovirus infection (Shen et al., Mol. Cell. Biol, 16: 4163–71 (1996)).

NOV22 is homologous to members of the nucleoside diphosphate kinase B family of proteins. Thus, the NOV22 nucleic acids and polypeptides, antibodies and related compounds according to the invention may be used to treat cancer, e.g. atherosclerosis, aneurysm, hypertension, fibromuscular dysplasia, stroke, scleroderma, obesity, transplantation, myocardial infarction, embolism, cardiovascular disorders, bypass surgery, fertility disorders, myasthenia gravis, leukodystrophies, pain, neuroprotection, systemic lupus erythematosus, autoimmune disease, asthma, emphysema, scleroderma, allergy, ARDS and other diseases, disorders and conditions of the like.

NOV23 is homologous to members of the T-cell family of proteins. Thus, the NOV23 nucleic acids and polypeptides, antibodies and related compounds according to the invention may be used to immune disorders, e.g., inflammation, allergies, autoimmune disease, and asthma.

NOV24 is homologous to members of the organic anion transporter (OAT) 3 family of proteins. Thus, the NOV24 nucleic acids and polypeptides, antibodies and related compounds according to the invention may be used to treat a wide range of disorders such as cancer, kidney disorders, immune disorders and other diseases, e.g., Von Hippel-Lindau (VHL) syndrome, Cirrhosis, Transplantation, Osteoporosis, Hypercalceimia, Arthritis, Ankylosing spondylitis, Scoliosis, Diabetes, Autoimmune disease, Renal artery stenosis, Interstitial nephritis, Glomerulonephritis, Polycystic kidney disease, Systemic lupus erythematosus, Renal tubular acidosis, IgA nephropathy, Lesch-Nyhan syndrome renal malfunction, nephrotoxicity, disease associated with cytotoxic drug, osteoporosis, osteopetrosis resistance, liver diseases, and heart diseases.

NOV25 and NOV26 are homologous to members of the ficolin family of proteins. Thus, such nucleic acid or protein therapeutics designed with the protein encoded for by NOV26 could function as an opsinin to target and eliminate bacteria by complement-mediated destruction. These proteins could be important for the treatment of bacterial septicemia. Ficolins may also have the ability to bind to elastins. Elastins are functionally important for lung alveolar development and inactivation of these proteins can lead to emphysema-like disease. Antibodies against NOV25 and NOV26 may prevent tissue destruction mediated by ficolin activity during emphysema, asthma and arthritis.

NOV27 is homologous to members of the peroxisomal Ca$^{2+}$-dependent solute carrier family of proteins. Thus, the NOV27 nucleic acids and polypeptides, antibodies and related compounds according to the invention may be used to treat metabolic disorders, e.g., cancer, trauma, regeneration (in vitro and in vivo), viral/bacterial/parasitic infections, atherosclerosis, aneurysm, hypertension, fibromuscular dysplasia, stroke, scleroderma, obesity, Von Hippel-Lindau (VHL) syndrome, Alzheimer's disease, stroke, tuberous sclerosis, hypercalceimia, Parkinson's disease, Huntington's disease, cerebral palsy, epilepsy, Lesch-Nyhan syndrome, multiple sclerosis, ataxia-telangiectasia, leukodystrophies, behavioral disorders, addiction, anxiety, pain, diabetes, autoimmune disease, renal artery stenosis, interstitial nephritis, glomerulonephritis, polycystic kidney disease, systemic lupus erythematosus, renal tubular acidosis, IgA nephropathy, hypercalceimia, muscular dystrophy, Lesch-Nyhan syndrome, and myasthenia gravis.

NOV28, NOV29, and NOV30 are homologous to members of the Na+/glucose cotransporter family of proteins. Thus, the NOV28 nucleic acids and polypeptides, antibodies and related compounds according to the invention may be used to treat metabolic, immune and renal disorders, e.g., metabolic diseases such as diabetes and hypertension, or cancer, trauma, regeneration (in vitro and in vivo), viral/bacterial/parasitic infections, diabetes, autoimmune disease, renal artery stenosis, interstitial nephritis, glomerulonephritis, polycystic kidney disease, systemic lupus erythematosus, renal tubular acidosis, IgA nephropathy, hypercalceimia, Lesch-Nyhan syndrome, cardiomyopathy, atherosclerosis, hypertension, congenital heart defects, aortic stenosis, atrial septal defect (ASD), atrioventricular (A-V) canal defect, ductus arteriosus, pulmonary stenosis, subaortic stenosis, ventricular septal defect (VSD), valve diseases, tuberous sclerosis, scleroderma, obesity, transplantation and other diseases, disorders and conditions of the like.

NOV32 is homologous to members of the phosphoenolpyruvate carboxykinase family of proteins. Thus, the NOV32 nucleic acids and polypeptides, antibodies and related compounds according to the invention may be used to treat metabolic disorders, e.g., hypoglycemia.

The NOVX nucleic acids and proteins of the invention, therefore, are useful in potential therapeutic applications implicated, for example but not limited to, in various pathologies/disorders as described herein and/or other pathologies/disorders. Potential therapeutic uses for the invention(s) are, for example but not limited to, the following: (i) a protein therapeutic, (ii) a small molecule drug target, (iii) an antibody target (therapeutic, diagnostic, drug targeting/cytotoxic antibody), (iv) a nucleic acid useful in gene therapy (gene delivery/gene ablation), (v) an agent promoting tissue regeneration in vitro and in vivo, and (vi) a biological defense weapon.

NOV1

The disclosed NOV1 nucleic acid (alternatively referred to herein as CG56181-01) encodes a novel neutrophin-6 alpha-like protein and includes the 796 nucleotide sequence (SEQ ID NO:1) shown in Table 1A. The novel NOV1 nucleic acid of the invention maps to chromosome 19.

An open reading frame for the mature protein was identified beginning with an AGC, but no start codon, and ending with a TGA stop codon at nucleotides 775–777. Putative untranslated regions, if any, are found upstream from the initiation codon and downstream from the termination codon. The start and stop codons are in bold letters.

TABLE 1A

NOV1 Nucleotide Sequence (SEQ ID NO:1)

AGCAAGGGCTTCCCCATAATCCTGGCAGGCAGGCCTCCCCTGGGGTTTCCAACTTCTGACCCCACTGAAGTGTTT
ATCCTCTTCTCTAACCCCAGCCTCCTTTTCCCTGTCTCCATGTGCTCTGAGAGATGCTCTGAGAGATGCTCCCAC
TCCCCCAGGCTCCCTCTGCATCCCCCTCATTTTCTTCCTCCCCAGTGTGTCAATGGAGTCCTGGCCCCCACCCTC
TCGACATTGTCACCTTTTCCTGATCCAAAGTGGGACCTTCTTTTCCCCCAAGTGGTCCTGTCTAGGGGTGCCGCT
GCCGGGCCCCCTCTGGTCTTCCTGCTGCAGACTGGGGCCTTTTGGGAGTCAGCAGGCGCCCGGGCCAACCGCAGC
CAGCGTGAGGCGAGCGATGCTTCACCGGCGAGTCATCAGGGTGAGCTGGCCGTGTGCGATGCAGTCAGTGTCTGG
GTGACAGATCCCGGGACTGCTGTGGACTTGGTTGTGCTCGAGGTGGAGGTGTTGGGCGAGGTGCCTGCAGCTGTC
GGCAGTTCCCTCCACCAACACTTCTTTGTTGCCCACTTCGAGGCCGATAACTCTGAGGAAGGTGGCCCGGGGGTA
GGTGGAGGGGCTGCCGCCGGGGTGTGGACCGGGGGGCACTGGGTGTCTGAGTGCAAGGCCAAGCAGTCCTATGTG
CGGGCATTGACCGCTGATGCCCAGGGCCGTGTGGACTGGCGATGGATTCAAATTGGCACTGCCTGTGTCTGCACA
CTCCTCAGCCGGACTGGCCGGGCCTGAGACCCATGCCCAGGAACTG

The NOV1 protein (SEQ ID NO:2) encoded by SEQ ID NO:1 is 258 amino acid residues in length and is presented using the one-letter amino acid code in Table 1B. The SignalP, Psort and/or Hydropathy results indicate that NOV1 has a signal peptide and is likely to be localized in the microbody (peroxisome) with a certainty of 0.5952. Alternatively, a NOV1 polypeptide is located to the cytoplasm with a certainty of 0.4500, the lysosome (lumen) with a certainty of 0.2100, or the mitochondrial matrix space with a certainty of 0.1000.

TABLE 1B

Encoded NOV1 Protein Sequence (SEQ ID NO:2)

SKGFPIILAGRPPLGFPTSDPTEVFILFSNPSLLFPVSMCSERCSERCSHSPRLPLHPPHFLPPQCVNGVLAPTL
STLSPFPDPKWDLLFPQVVLSRGAAAGPPLVFLLQTGAFWESAGARANRSQREASDASPASHQGELAVCDAVSVW
VTDPGTAVDLVVLEVEVLGEVPAAVGSSLHQHFFVAHFEADNSEEGGPGVGGGAAAGVWTGGHWVSECKAKQSYV
RALTADAQGRVDWRWIQIGTACVCTLLSRTGRA

A search against the Patp database, a proprietary database that contains sequences published in patents and patent publication, yielded several homologous proteins shown in Table 1C.

TABLE 1C

PatP Results for NOV1

| Sequences Producing High-Scoring Segment Pairs: | | High Score | Smallest Sum Prob P (N) |
|---|---|---|---|
| patp:AAR22467 | Neurotrophic factor 4-gamma — *Homo sapiens* | 1175 | 3.8e-119 |
| patp:AAR22466 | Neurotrophic factor 4-beta — *Homo sapiens* | 1047 | 1.4e-105 |
| patp:AAR22468 | Neurotrophic factor 4-delta — *Homo sapiens* | 864 | 3.4e-86 |
| patp:AAR29735 | Human NT-4, encoded by clone 7-2 | 680 | 1.1e-66 |
| patp:AAR30691 | Human neutrophin-4 | 678 | 1.8e-66 |

In a BLAST search of public sequence databases, it was found, for example, that the NOV1 nucleic acid sequence of this invention has 762 of 796 bases (95%) identical to a gb:GENBANK-ID:HUMINT4PSG|acc:M86529.1 mRNA from Human neurotrophin-4 pseudogene sequence. Further, the full amino acid sequence of the disclosed protein of the invention has 239 of 258 amino acid residues (92%) identical to, and 244 of 258 amino acid residues (94%) similar to, the 257 amino acid residue ptnr:SWISSPROT-ACC: P34132 protein from Human (NEUROTROPHIN-6 ALPHA (NT-6 ALPHA)).

In all BLAST alignments herein, the "E-value" or "Expect" value is a numeric indication of the probability that the aligned sequences could have achieved their similarity to the BLAST query sequence by chance alone, within the number of hits one can "expect" to see just by chance when searching a database of a particular size. It decreases exponentially with the Score (S) that is assigned to a match between two sequences. Essentially, the E value describes the random background noise that exists for matches between sequences. Blasting is performed against public nucleotide databases such as GenBank databases and the GeneSeq patent database. For example, BLASTX searching is performed against public protein databases, which include GenBank databases, SwissProt, PDB and PIR.

The Expect value is used as a convenient way to create a significance threshold for reporting results. The default value used for blasting is typically set to 0.0001. In BLAST 2.0, the Expect value is also used instead of the P value (probability) to report the significance of matches. For example, an E value of one assigned to a hit can be interpreted as meaning that in a database of the current size one might expect to see one match with a similar score simply by chance. An E value of zero means that one would not expect to see any matches with a similar score simply by chance. See, e.g., http://www.ncbi.nlm.nih.gov/Education/BLASTinfo/. Occasionally, a string of X's or N's will result from a BLAST search. This is a result of automatic filtering of the query for low-complexity sequence that is performed to prevent artifactual hits. The filter substitutes any low-complexity sequence that it finds with the letter "N" in nucleotide sequence (e.g., "NNNNNNNNNNNNN") or the letter "X" in protein sequences (e.g., "XXXXXXXXX"). Low-complexity regions can result in high scores that reflect compositional bias rather than significant position-by-position alignment. Wootton and Federhen, Methods Enzymol 266:554–571, 1996.

The NOV1 protein of the invention also has homolgy to the proteins shown in the BLASTP data in Table 1D.

TABLE 1D

NOV1 BLASTP Results

| Gene Index/ Identifier | Protein/Organism | Length of aa | Identity (%) | Positives (%) | Expect Value |
|---|---|---|---|---|---|
| Q96K94 | CDNA FLJ14428 FIS, CLONE HEMBA1006293 — *Homo sapiens* (Human) | 301 | 132/135 (97%) | 133/135 (98%) | 1.3e-70 |
| AAL35776 | TIM3 — *Mus musculus* (Mouse) | 281 | 87/136 (63%) | 99/136 (72%) | 1.6e-40 |
| AAL35774 | TIM1 — *Mus musculus* (Mouse) | 305 | 55/120 (45%) | 71/120 (59%) | 1.6e-22 |
| AAL35775 | TIM1 — *Mus musculus* (Mouse) | 282 | 54/120 (45%) | 70/120 (58%) | 5.5e-22 |
| O54947 | KIDNEY INJURY MOLECULE-1 PRECURSOR (KIM-1) — *Rattus norvegicus* (Rat) | 307 | 54/121 (44%) | 72/121 (59%) | 7.1e-22 | database that was searched. For example, the probability that the subject ("Sbjct") retrieved from the IIT BLAST analysis, matched the Query IIT sequence purely by chance is the E value. The Expect value (E) is a parameter that describes the A multiple sequence alignment is given in Table 1E, with the NOV1 protein of the invention being shown in line 1 in a ClustalW analysis comparing NOV with related protein sequences of Table 1D.

Table 1E. ClustalW Analysis of NOV1

1. SEQ ID NO.: 2    NOV1
2. SEQ ID NO.: 124    Q96K94
3. SEQ ID NO.: 125    AAL35776
4. SEQ ID NO.: 126    AAL35774
5. SEQ ID NO.: 127    AAL35775
6. SEQ ID NO.: 128    O54947

```
              10        20        30        40        50        60
      ....|....|....|....|....|....|....|....|....|....|....|....|
NOV1     -SKGFPIILAGRPPLGFPISDPTEVFILFSNPSLLFPVSMC--SER-----CSERCSHSP  52
Q96K94   MFSHLPFDCVLLLLLLLTRSSEVEYRAEVGQNAYLPCFYTPAAPGNLVPVCWGKGACPV  60
AAL35776 MFSGLTLNCVLLLLQLLLARSLENAYVFEVGKNAYLPCSYTLSTPGALVPMCWGKGFCPW  60
AAL35774 -MNQLQVFISGLILLLPGTVDSYVEVKGVVGHPVTLPCTYS--TYRGITTTCWGRGQCPS  57
AAL35775 -MNQLQVFISGLILLLPGAVDSYVEVKGVVGHPVTLPCTYS--TYRGITTTCWGRGQCPS  57
O54947   -MVQLQVFISGLLLLLPGSVDSYEVVKGVVGHPVTIPCTYS--TRGGITTTCWGRGQCPY  57

70        80        90       100       110       120
      ....|....|....|....|....|....|....|....|....|....|....|....|
NOV1     RLPLHPPHPLPPQCVNGVLAPTLSTLSPFPDPKWDLLFPQVWLSR-----------GAAA 101
Q96K94   FECGNVVLRIDERDVNYWTS-RYWLNGDFRKGDVSLTIENVTLADSGLYCCRLQIPGIMN 119
AAL35776 SQCTNELLRTDERNVTYQKSSRYQLKGDLNKGDVSLIIKNVTLDDHGTYCCRLQFPGLMN 120
AAL35774 SACQNTLIWTNGHRVTYQKSSRYNLKGHISEGDVSLTIENSVESDSGLYCCRVEIPGWFN 117
AAL35775 SACQNTLIWTNGHRVTYQKSSRYNLKGHISEGDVSLTIENSVESDSGLYCCRVEIPGWFN 117
O54947   SSCQNILIWINGYQVTYRSSGRYNIKGRISEGDVSLTIENSVDSDSGLYCCRVEIPGWFN 117
```

```
                     130       140       150       160       170       180
                ....|....|....|....|....|....|....|....|....|....|....|....|
NOV1       GPPLVELLQTGAFWESAGARANRSQREASDASPASHQGELAVC----------DAVSV  149
Q96K94     DEKFNLKLVIKPAKVTP---APTLQRDFTAAFPRMLTTRGHGP----------AETQT  164
AAL35776   DKKLELKLDIKAAKVTP---AQTAHGDSTTASPRTLTTERNG-----------SETQT  164
AAL35774   DQKVTFSLQVKPEIPTRPPTRPTTTRPTATGRPTTISTRSTHVPTSIRVSTSTPPISTHT  177
AAL35775   DQKVTFSLQVKPEIPTRPPRRPTTTRPTATGRPTTISTRSTHVPTSTRVSTSTPPISTHT  177
O54947     DQKMTFSLEVKPEIPTSPPTRPTTITRPTTT-RPTTISTRSTHVPTSTRVSTSTP-IPEQT  175

190       200       210       220       230       240
              ....|....|....|....|....|....|....|....|....|....|....|....|
NOV1       WVTDPG---------------------TAVDLVVLEVEVLGEVPAAVGSSLHQHFFVAH  187
Q96K94     LGSLPD---------------------INLTQISTLANELRDSRLANDLRDSGATIRIG  202
AAL35776   LVTLHN---------------------NNGTKISTWADEIKDS---------GETIRTA  193
AAL35774   WTHKPEPTTFCPHETTAEVTGIPSHTPTDWNGTVTSSGDTWSNHTEAIPPGKPQKNPTKG  237
AAL35775   WTHKP----------------------DWNGTVTSSGDTWSNHTEAIPPGKPQKNPTKG  214
O54947     QTHKPEITTFYAHETTAEVTETPSYTPADWNGTVISSEEAWNNHTVRIPLRKPQRNPTKG  235

250       260       270       280       290       300
              ....|....|....|....|....|....|....|....|....|....|....|....|
NOV1       EEADNSEEGGPGVGGGAAAGVWIGGHWVSECKAKQSYVRALTADAQGRVDWRWIQIGTAC  247
Q96K94     IYIGAGICAGLALALIFGALIFKWYSHSKEKIQNLSLISLANLPPSGLANAVAEGIRSEE  262
AAL35776   IHIGVGVSAGLTLALIIGVLLLKWYSCKKKKLSSLSLITLANLPPGGLANAGAVRIRSEE  253
AAL35774   FYVGLCIAA-LLLLLLVSTVAITRYILMKRKSASLSVVAFRVSKIEALQNAAVVHSRAED  296
AAL35775   FYVGLCIAA-LLLLLLVSTVAITRYILMKRKSASLSVVAFRVSKIEALQNAAVVHSRAED  273
O54947     FYVGMSVAA-LLLLLLASTVVVTRYIILRKKMGSLSFVAFHVSKSRALQNAAIVHPRAED  294

310       320       330
              ....|....|....|....|....|....|....
NOV1       VCTLLSRTGRA-----------------------  258
Q96K94     NIYTIEENVYEVEEPNEYYCYVSSRQQPSQPLGCRFAMP  301
AAL35776   NIYTIEENVYEVENSNEYYCYVNS-QQPS--------  281
AAL35774   NIYIVEDRP-----------------------  305
AAL35775   NIYIVEDRP-----------------------  282
O54947     NIYIIEDRSRGAE-------------------  307
```

The presence of identifiable domains in the disclosed NOV1 protein was determined by using Pfam and then determining the Interpro number. The results are listed in Table 1F with the statistics and domain description.

TABLE 1F

Domain Analysis of NOV1

| PSSMs Producing Significant Alignments | Score (bits) | E Value |
|---|---|---|
| NGF: domain 1 of 2, from 133 to 184 | 70.6 | 1.5e-19 |

```
NGF       epvsrRGElSVCDSvSvWVTnDKttAvDirGkeVtVLgeVninngp.
          ++++++||++|||++|+||| |  +|+|+  +|+||++|+++ +++
NOV1      SPASHQGELAVCDAVSVWVT-DPGTAVDLVVLEVEVLGEVPAAVGSs NGF       lKQYFF     (SEQ ID NO:129)
          +  |  ||
NOV1      LHQHFF     (SEQ ID NO:2)
```

| NGF: domain 2 of 2, from 213 to 258 | 100.5 | 2.5e-28 |
|---|---|---|

```
NGF       HWnSeCkttqtYVRALTmdnnklVgWRfIRIDTACVCtLsrKtGrt     (SEQ ID NO:130)
          ||+|+|+++++|||||+++++++| ||+|  | |||||+|++++|++
NOV1      HWVSECKAKQSYVRALTADAQGRVDWRWIQIGTACVCTLLSRTGRA     (SEQ ID NO:2)
```

Consistent with other known members of the neurotrophin family of proteins, NOV1 contains nerve growth factor domains as illustrated in Table 1F.

The NOV1 nucleic acid, and the encoded polypeptide, according to the invention are useful in a variety of applications and contexts. For example, NOV1 nucleic acids and polypeptides can be used to identify proteins that are members of the neurotrophin family of proteins. The NOV1 nucleic acids and polypeptides can also be used to screen for molecules, which inhibit or enhance NOV1 activity or function. Specifically, the nucleic acids and polypeptides according to the invention may be used as targets for the identification of small molecules that modulate or inhibit, e.g., development and survival of certain sympathetic and sensory neurons in both the central and peripheral nervous systems. These molecules can be used to treat, e.g., proinflammatory disorder, immune disorder, and inflammatory disease.

In addition, the NOV1 nucleic acid and polypeptide according to the invention are useful, inter alia, as novel members of the protein families according to the presence of domains and sequence relatedness to previously described proteins. For example, the NOV1 nucleic acid and polypeptide include structural motifs that are characteristic of proteins belonging to the family of nerve growth factors such as the neurotrophin proteins. Nerve growth factor (NGF) is the prototype for the neurotrophin family of polypeptides which are essential in the developments and survival of certain sympathetic and sensory neurons in both the central and peripheral nervous systems. NGF was discovered when mouse sarcoma tissue transplants in chicken embryos caused an increase in the size of spinal ganglia.

The NOV1 nucleic acid and polypeptide, antibodies and related compounds according to the invention will be useful in therapeutic and diagnostic applications in the mediation of the peripheral and central nervous system. As such the NOV1 nucleic acid and polypeptide, antibodies and related compounds according to the invention may be used to treat immune and nervous system disorders, e.g., proinflammatory disorder, immune disorder, inflammatory disease, septic shock, arthritis, bone pain, or bone deformity.

The NOV1 nucleic acid and polypeptide are useful for detecting specific cell types. For example, expression analysis has demonstrated that a NOV1 nucleic acid is expressed in placenta and uterus.

Additional utilities for the NOV1 nucleic acid and polypeptide according to the invention are disclosed herein.

NOV2

The disclosed NOV2 nucleic acid (alternatively referred to herein as CG56275-01) encodes a novel Guanylate kinase-like protein and includes the 1336 nucleotide sequence (SEQ ID NO:3) shown in Table 2A. The novel NOV2 nucleic acid of the invention maps to chromosome 2.

An open reading frame for the mature protein was identified beginning with an ATG initiation codon at nucleotides 3–5, and ending with a TGA stop codon at nucleotides 1326–1328. Putative untranslated regions, if any, are found upstream from the initiation codon and downstream from the termination codon. The start and stop codons are in bold letters.

TABLE 2A

NOV2 Nucleotide Sequence (SEQ ID NO: 3)

CATGAGGATTGTTTGTTTAGTGAAAAACCAACAGCCCCTGGGAGCCACCATCAAGCGCCACGAGATGACAGGGG
ACATCTTGGTGGCCAGGATCATCCACGGTGGGCTGGCGGAGAGAAGTGGGTTGCTATATGCTCGAGACAAACTGG
TAGAAGTGAATGGAGTTTCAGTTGAGGGACTGGACCCTGAACAAGTGATCCATATTCTGGCCATGTCTCGAGGCA
CAATCATGTTCAAGGTGGTTCCAGTCTCTGACCCTCCTGTGAATAGCCAGCAGATGGTAAGAATTGTGTACGTCC
GTGCCATGACTGAGTACTGGCCCCAGGAGGATCCCGACATCCCCTGCATGGACGCTGGATTGCCTTTCCAGAAGG
GGGACATCCTCCAGATTGTGGACCAGAATGATGCCCTCTGGTGGCAGGCCCGAAAAATCTCAGACCCTGCTACCT
GCGCTGGGCTTGTCCCTTCTAACCACCTTCTGAAGAGGAGGAAGCAACGGGAATTCTGGTGGTCTCAGCCGTACC

TABLE 2A-continued

NOV2 Nucleotide Sequence (SEQ ID NO: 3)

AGCCTCACACCTGCCTCAAGTCAACCCTACAACTGAAGGAGGAGTTTGTTGGCTACGGTCAGAAGTTCTTTATAG
GTAGGTCTCACCTCAGCCCGCTGCATGCCAGTGTGTGCTGCACCGGCAGCTGCTACAGTGCAGTGGGTGCCCCTT
ACGAGGAGGTGGTGAGGTACCAGCGACGCCCTTCAGACAAGTACCGCCTCATAGTGCTCATGGGTATGTCCTTAG
GACCCTCTGGTGTTGGAGTAAATGAGCTCAGAAGACAACTTATTGAATTTAATCCCAGCCATTTTCAAAGTGCTG
TGCCAACTACTCGTACTAAAAAGAGTTACGAAATGAATGGGCGTGAGTATCACTATGTGTCCAAGGAAACATTTG
AAAACCTCATATATAGTCACAGGAGGATGCTGGAGTATGGTGAGTACAAAGGCCACCTGTATGGCACTAGTGTGG
ATGCTGTTCAAACAGTCCTTGTCGAAGGAAAGATCTGTGTCATGGACCTAGAGCCTCAGAATATGAGGTGTATGA
AACAATCTCGGAAAAATGCCAAGGTTATTACTGACTACTATGTGGACATGAAGTTCAAGGTAAGAGCAAGTCAAA
AACTAAAGGATGAAGACCTACAAGAGATGGAAAATTTAGCCCAAAGAATGGAAACTCAGTTTGGCCAATTTTTTG
ATCATGTGATTGTGAATGACAGCTTGCACGATGCATGTGCCCAGTTGTTGTCTGCCATACAGAAGGCTCAGGAGG
AGCCTCCAGTGGGTACCAGCAACATGGATTTCCTCAGATACTGAGTCTCAATGAGACTTCTT

The NOV2 protein (SEQ ID NO:4) encoded by SEQ ID NO:3 is 441 amino acid residues in length and is presented using the one-letter amino acid code in Table 2B. The SignalP, Psort and/or Hydropathy results indicates that NOV2 has a signal peptide and is likely to be localized in the microbody (peroxisome) with a certainty of 0.3000. Alternatively, a NOV2 polypeptide is located to the nucleus with a certainty of 0.3000, the mitochondrial matrix space with a certainty of 0.1000, or the lysosome (lumen) with a certainty of 0.1000.

TABLE 2B

Encoded NOV2 Protein Sequence (SEQ ID NO: 4)

MRIVCLVKNQQPLGATIKRHEMTGDILVARIIHGGLAERSGLLYAGDKLVEVNGVSVEGLDPEQVIHILAMSRGT
IMFKVVPVSDPPVNSQQMVRIVYVRAMTEYWPQIDPDIPCMDAGLPFQKGDILQIVDQNDALWWQARKISDPATC
AGLVPSNHLLKRRKQREFWWSQPYQPHTCLKSTLQLKEEFVGYGQKFFIGRSHLSPLHASVCCTGSCYSAVGAPY
EEVVRYQRRPSDKYRLIVLMGMSLGPSGVGVNELRRQLIEFNPSHFQSAVPTTRTKKSYEMNGREYHYVSKETFE
NLIYSHRRMLEYGEYKGHLYGTSVDAVQTVLVEGKICVMDLEPQNMRCMKQSRKNAKVITDYYVDMKFKVRASQK
LKDEDLQEMENLAQRMETQFGQFFDHVIVNDSLHDACAQLLSAIQKAQEEPQWVPATWISSDTESQ

Small nucleotide polymorphisms (SNP) variants of NOV2 are disclosed in Example 2.

A search against the Patp database, a proprietary database that contains sequences published in patents and patent publication, yielded several homologous proteins shown in Table 2C.

TABLE 2C

PatP Results for NOV2

| Sequences Producing High-Scoring Segment Pairs: | High Score | Smallest Sum Prob P (N) |
|---|---|---|
| patp: AAE11774 Human kinase (PKIN)-8 protein | 2074 | 2.1e−214 |
| patp: AAU07123 Human novel human protein, NHP #23 | 823 | 7.6e−82 |
| patp: AAU07119 Human novel human protein, NHP #19 | 775 | 9.3e−77 |
| patp: AAU07115 Human novel human protein, NHP #15 | 713 | 3.5e−70 |
| patp: AAU07111 Human novel human protein, NHP #11 | 709 | 9.2e−70 |

In a BLAST search of public sequence databases, it was found, for example, that the NOV2 nucleic acid sequence of this invention has 313 of 392 bases (79%) identical to a gb:GENBANK-ID:AB30499|acc:AB030499.1 mRNA from *Rattus norvegicus* (*Rattus norvegicus* mRNA for DLG6 alpha, complete cds). Further, the full amino acid sequence of the disclosed NOV2 protein of the invention has 346 of 441 amino acid residues (78%) identical to, and 380 of 441 amino acid residues (86%) similar to, the 441 amino acid residue ptnr:SPTREMBL-ACC:Q9QYH1 protein from *Rattus norvegicus* (Rat) (DLG6 ALPHA).

The NOV2 protein of the invention also has homolgy to the proteins shown in the BLASTP data in Table 2D.

TABLE 2D

NOV2 BLASTP Results

| Gene Index/ Identifier | Protein/Organism | Length of aa | Identity (%) | Positives (%) | Expect Value |
|---|---|---|---|---|---|
| Q96JB8 | MEMBRANE PROTEIN PALMITOYLATED 4—*Homo Sapiens* | 637 | 227/249 (91%) | 228/249 (91%) | 7.8e−209 |
| Q96Q44 | ALS2CR5 PROTEIN—*Homo sapiens* | 593 | 381/442 (86%) | 392/442 (88%) | 3.2e−186 |
| Q920P8 | MDLG6A—*Mus musculus* (Mouse) | 485 | 182/248 (73%) | 207/248 (83%) | 1.1e−176 |
| Q920P7 | MDLG6B—*Mus musculus* (Mouse) | 479 | 182/248 (73%) | 207/248 (83%) | 4.7e−176 |
| Q9QYH1 | DLG6 ALPHA—*Rattus norvegicus* (Rat) | 441 | 346/441 (78%) | 380/441 (86%) | 6.2e−174 |

A multiple sequence alignment is given in Table 2E, with the NOV2 protein of the invention being shown in line 1 in a ClustalW analysis comparing NOV2 with related protein sequences of Table 2D.

Table 2E. ClustalW Analysis of NOV2

1. SEQ ID NO.: 4      NOV2
2. SEQ ID NO.: 131      Q96JB8
3. SEQ ID NO.: 132      Q96Q44
4. SEQ ID NO.: 133      Q920P8
5. SEQ ID NO.: 134      Q920P7
6. SEQ ID NO.: 135      Q9QYH1

```
                10        20        30        40        50        60
       ....|....|....|....|....|....|....|....|....|....|....|....|
NOV2   ------------------------------------------------------------   1
Q96JB8 MIQSDKGADPPDKKDMKLSTATNPQNGLSQILRLVLQELSLFYSRDVNGVCLLYDLLHSP  60
Q96Q44 MIQSDKGADPPDKKDMKLSTATNPQNGLSQILRLVLQELSLFYGRDVNGVCLLYDLLHSP  60
Q920P8 ------------------------------------------------------------   1
Q920P7 ------------------------------------------------------------   1
Q9QYH1 ------------------------------------------------------------   1

70        80        90       100       110       120
```

```
            ....|....|....|....|....|....|....|....|....|....|....|....|
NOV2    ------------------------------------------------------------   1
Q96JB8  WLQALLKIYDCLQEFKEKKLVPATPHAQVLSYEVVELLRETPTSPEIQELRQMLQAPHFK 120
Q96Q44  WLQALLKIYDCLQEFKEKKLVPATPHAQVLSYEVVELLRETPTSPEIQELRQMLQAPHFK 120
Q920P8  ------------------------------------------------------------   1
Q920P7  ------------------------------------------------------------   1
Q9QYH1  ------------------------------------------------------------   1

130       140       150       160       170       180
            ....|....|....|....|....|....|....|....|....|....|....|....|
NOV2    --------------------------------MRIVCLVKNQQPLGATIKRHEMTGDILVA  29
Q96JB8  ALLSAHDTIAQKDFEPLLPPLPDNIPESEEAMRIVCLVKNQQPLGATIKRHEMTGDILVA 180
Q96Q44  ALLSAHDTIAQKDFEPLLPPLPDNIPESEEAMRIVCLVKNQQPLGATIKRHEMTGDILVA 180
Q920P8  --------------------------------MRIVCLVKNQQPLGATIKRHEMTGDILVA  29
Q920P7  --------------------------------MRIVCLVKNQQPLGATIKRHEMTGDILVA  29
Q9QYH1  --------------------------------MRTVCLVKNQQPLGATIKRHEMTGDILVA  29

190       200       210       220       230       240
            ....|....|....|....|....|....|....|....|....|....|....|....|
NOV2    RIIHGGIAERSGLLYAGDKLVEVNGVSVEGLDPEQVIHILAMSRGTIMFKVVPVSDPPVN  89
Q96JB8  RIIHGGIAERSGLLYAGDKLVEVNGVSVEGLDPEQVIHILAMSRGTIMFKVVPVSDPPVN 240
Q96Q44  RIIHGGIAERSGLLYAGDKLVEVNGVSVEGLDPEQVIHILAMSRGTIMFKVVPVSDPPVN 240
Q920P8  RIIHGGLVERSGLLYAGDKLVEVNGVSVEGLDPEQVIHILAMSCGTIMFKVIPVSAPPVS  89
Q920P7  RIIHGGLVERSGLLYAGDKLVEVNGVSVEGLDPEQVIHILAMSCGTIMFKVIPVSAPPVS  89
Q9QYH1  RVIHGGLVERNGLLYAGDKLVEVNGVPVEGLDPEQVIHILAMSCGTIMFKVIPVSAPPVS  89

250       260       270       280       290       300
            ....|....|....|....|....|....|....|....|....|....|....|....|
NOV2    SQQMVRIVYVRAMTEYWPQEDPDIPCMDAGLPFQKGDILQIVDQNDALWWQARKISDPAT 149
Q96JB8  SQQMV---YVRAMTEYWPQEDPDIPCMDAGLPFQKGDILQIVDQNDALWWQARKISDPAT 297
Q96Q44  SQ-------------QMDPDIPCMDAGLPFQKGDILQIVDQNDALWWQARKISDPAT 284
Q920P8  SQKMG---YVRAMIDYWPQEDPDIPCMDAGLPFLKGDILQIVDQNDALWWQARKISDLTI 146
Q920P7  SQKMG---YVRAMIDYWPQEDPDIPCMDAGLPFLKGDILQIVDQNDALWWQARKISDLTI 146
Q9QYH1  SQTTV---YVRAMIDYWPQEDPDIPCMDAGLPFLKGDILQIVDQSDALWWQARKISDIAI 146

310       320       330       340       350       360
            ....|....|....|....|....|....|....|....|....|....|....|....|
NOV2    CAGLLPSNHLLKRRKQREFWWSQPYQPHTCLKSTLQ------------------------ 185
Q96JB8  CAGLLPSNHLLKR-KQREFWWSQPYQPHTCLKSTLSISMEEEDDMKIDEKCVEADEETFE 356
Q96Q44  CAGLLPSNHLLKR-KQREFWWSQPYQPHTCLKSTL------------------------- 318
Q920P8  CAGLLPSNHLLKR-KQREFWWSQPYQPHTCLKSTRALSMEEEDSMKIDEKCVEADEETFE 205
Q920P7  CAGLLPSNHLLKR-KQREFWWSQPYQPHTCLKSTR------EDSMKIDEKCVEADEETFE 199
Q9QYH1  CAGLLPSNHLLKR-KQREFWWSQPYQPHTCLKSTR------------------------- 180

370       380       390       400       410       420
            ....|....|....|....|....|....|....|....|....|....|....|....|
NOV2    ------LKEEFVGYGQKFFIG----------RSHLSPLHASVCCTGSCYSAVGAPYEEV 228
Q96JB8  SEELSEDKEEFVGYGQKFFIAGFRRSMRLCRRKSHLSPLHASVCCTGSCYSAVGAPYEEV 416
Q96Q44  ------YKEEFVGYGQKFFIAGFRRSMRLCRRKSHLSPLHASVCCTGSCYSAVGAPYEEV 372
Q920P8  SEELAEAKDEFVGDGQKFFIAGFRRSMRLCRRKSHFSQLHASLCCSCSCYSAVGAPYEEV 265
Q920P7  SEELAEAKDEFVGDGQKFFIAGFRRSMRLCRRKSHFSQLHASLCCSCSCYSAVGAPYEEV 259
Q9QYH1  ------SKEEFVGDGQQFFIAGFR--------QQHANMRCTCSCYSAVGAPYEEV 221

430       440       450       460       470       480
            ....|....|....|....|....|....|....|....|....|....|....|....|
NOV2    VRYQRRPSDKYRLIVLMGMSLGPSGVGVNELRRQLIEFNPSHFQSAVP-TTRKKSYEMN 287
Q96JB8  VRYQRRPSDKYRLIVL----GPSGVGVNELRRQLIEFNPSHFQSAVPHTTRKKSYEMN 472
```

```
Q96Q44   VRYQRRPSDKYRLIVLM----GPSGVGVNELRRQLIEFNPSHFQSAVPHTTRTKKSYEMN 428
Q920P8   VRYQRQPADKYRLIVLV----GPSGVGVNELRRQLIGCNPSCFQSAVPHTTRSPKSYEMD 321
Q920P7   VRYQRQPADKYRLIVLV----GPSGVGVNELRRQLIGCNPSCFQSAVPHTTRSPKSYEMD 315
Q9QYH1   VRYQRQPADKYRLIVLV----GPSGVGVNELRRQLIGCNPSCFQSAVPHTTRSPKSYEMD 277

490       500       510       520       530       540
           ....|....|....|....|....|....|....|....|....|....|....|....|
NOV2     GREYHYVSKETFENLIYSHRRMLEYGEYKGHLYGTSVQAVQTVLVEGKICVMDLEPQ--- 344
Q96JB8   GREYHYVSKETFENLIYSHR-MLEYGEYKGHLYGTSVQAVQTVLVEGKICVMDLEPQDIQ 531
Q96Q44   GREYHYVSKETFENLIYSHR-MLEYGEYKGHLYGTSVQAVQTVLVEGKICVMDLEPQDIQ 487
Q920P8   GREYHYVSRETFESLMYGHK-MLEYGEYKGHLYGTSVNAVHAVLDEGKICTMDLEPQDIQ 380
Q920P7   GREYHYVSRETFESLMYGHK-MLEYGEYKGHLYGTSVNAVHAVLDEGKICTMDLEPQDIQ 374
Q9QYH1   GREYHYVSRETFESLMYGHR-MLESGEYKGHLYGTSVNAVLAVLDEGKICVMDLEPQDIQ 336

550       560       570       580       590       600
           ....|....|....|....|....|....|....|....|....|....|....|....|
NOV2     ------------NMRCMKQSRKNAKVITDYYVDMKFKVRASQKLKDEDLQEMENL 387
Q96JB8   GVRTHELKPYVIFIKPSNMRCMKQSRKNAKVITDYYVDMKFK-------DEDLQEMENL 583
Q96Q44   GVRTHELKPYVIFIKPSNMRCMKQSRKNAKVITDYYVDMKFK-------DEDLQEMEEL 539
Q920P8   LARTRDLKPCVIFIKPPNTSSMRHSRKNAKTTDYYVDMKFK-------DEDLQEMEEL 432
Q920P7   LARTRDLKPCVIFIKPPNMSSMRHSRNAKITDYYVDMKFK-------DEDLQEMEEL 426
Q9QYH1   LARTRELKPYVIFIKPPSMSSMRHSRRNAKITDYYVDMKFK-------DEDLQEMEEL 388

610       620       630       640       650
           ....|....|....|....|....|....|....|....|....|....
NOV2     AQRMEIQFGQFFDHVIVNDSLHDACAQLLSAIQKAQEEPQWVPATWISSDTESQ 441
Q96JB8   AQRMEIQFGQFFDHVIVNDSLHDACAQLLSAIQKAQEEPQWVPATWISSDTESQ 637
Q96Q44   AQRMESQFGQFFDHVIVNDSLHDACAQLLSAIQRAQEELQWVPEAWVSPDTES- 485
Q920P8   AQKMESQFGQFFDHVIVNDNLQDACGQLLSAIQRAQEELQWVPEAWVSPDTES- 479
Q920P7   AQKMESQFGQFFDHVIVNDNLQDARAQLLSAIQKAEEELQWVPEAWVSPGAES- 441
Q9QYH1   AQKMESQFGQFFDHVIVNDNLQDARAQLLSAIQKAEEELQWVPEAWVSPGAES- 441
```

The presence of identifiable domains in the disclosed NOV2 protein was determined by using Pfam and then determining the Interpro number. The results are listed in Table 2F with the statistics and domain description.

TABLE 2F

Domain Analysis of NOV2

| PSSMs Producing Significant Alignments | Score (bits) | E Value |
|---|---|---|
| Guanylate kin: domain 1 of 1, from 278 to 380 | 69.5 | 6.9e-17 |

```
GK      TRpVpRpgEvdGkdYhFVssrEemekdIaan.eFlEygefqgnyYGT
        ||+ +  +|  +|++|++|+ +|  ++++|   ++  +|++++ +++|||
NOV2    TRT-KKSYEMNGREYHYVS-KETFENLIYSHrRMLEYGEYKGHLYGT GK      sletvrqvakqgKiciLDvepQgvkrlrtaelsNPivvFIaPpSlqelek
        ++ ++++++  +|++++|+++|  ++   ++      + ++    +    +++
NOV2    SVDAVQTVLVEGKICVMDLEPQNMRCMKQSRKN-AKVI---TDYYVDMKF GK      rLegrnkesEes        (SEQ ID NO:136)
        + +  ++   +
NOV2     KVRASQKLKDED       (SEQ ID NO:4)
```

Consistent with other known members of the guanylate kinase family of proteins, NOV2 contains guanylate kinase domains as illustrated in Table 2F.

The NOV2 nucleic acid, and the encoded polypeptide, according to the invention are useful in a variety of applications and contexts. For example, NOV2 nucleic acids and polypeptides can be used to identify proteins that are members of the guanylate kinase family of proteins. The NOV2 nucleic acids and polypeptides can also be used to screen for molecules, which inhibit or enhance NOV2 activity or function. Specifically, the nucleic acids and polypeptides according to the invention may be used as targets for the identification of small molecules that modulate or inhibit, e.g., cell signaling pathways, cell junction organization, or transmembrane regulation. These molecules can be used to treat, e.g., Von Hippel-Lindau (VHL) syndrome, diabetes, and tuberous sclerosis.

In addition, the NOV2 nucleic acid and polypeptide according to the invention are useful, inter alia, as novel members of the protein families according to the presence of domains and sequence relatedness to previously described proteins. For example, the NOV2 nucleic acid and polypeptide include structural motifs that are characteristic of proteins belonging to the family of kinases such as the guanylate kinase proteins. Guanylate kinase is a critical enzyme for biosynthesis of GTP and dGTP, and its role in nucleotide metabolism makes it a target for cancer chemotherapy. The structure of mouse guanylate kinase (gmk) includes an N-terminal ATP binding motif and a neighboring guanylate kinase signature sequence (GKSS). The low molecular mass cytosolic forms of guanylate kinase, such as gmk and guk1, are implicated in the regulation of the supply of guanine nucleotides to cell signaling pathways, while the related families of high molecular mass and membrane-associated forms of guanylate kinase, such as MAGUK, CASK, SAP102, ZO-1, and MAGI-1, have roles in cell junction organization and transmembrane regulation.

The NOV2 nucleic acid and polypeptide, antibodies and related compounds according to the invention will be useful in therapeutic and diagnostic applications in the mediation of biosynthesis and nucleotide metabolism. As such the NOV2 nucleic acid and polypeptide, antibodies and related compounds according to the invention may be used to treat genetic conditions, e.g., Von Hippel-Lindau (VHL) syndrome, diabetes, or tuberous sclerosis.

The NOV2 nucleic acid and polypeptide are useful for detecting specific cell types. For example, expression analysis has demonstrated that a NOV2 nucleic acid is expressed in synovium/synovial membrane.

Additional utilities for the NOV2 nucleic acid and polypeptide according to the invention are disclosed herein.

NOV3

The disclosed NOV3 nucleic acid (alternatively referred to herein as CG53400-01) encodes a novel hypothetical 85.6 kDa-like protein and includes the 3089 nucleotide sequence (SEQ ID NO:5) shown in Table 3A. The novel NOV3 nucleic acid of the invention maps to chromosome 12.

An open reading frame for the mature protein was identified beginning with an ATG initiation codon at nucleotides 48–50, and ending with a TAA stop codon at nucleotides 30273029. Putative untranslated regions, if any, are found upstream from the initiation codon and downstream from the termination codon. The start and stop codons are in bold letters.

TABLE 3A

NOV3 Nucleotide Sequence (SEQ ID NO: 5)

GCTGTTCTGGGGAGAAATTGTTGAGTGTTTTCCACTTTAACCTTGCAATGGAATCAGCGGGGCCGCGCTCTCCCT
GCAGCCGCCACCGCAGCCGCCGCCTGGGCCGCTCCGTGTCCCCGGTGGAGCCGCCGCCGCCGCCGCCGGGAGCTC
GATGCGGACGGAGCCCGGGCCGAGCCATGGGGATCCTCAGCATCACGGACCAGCCGCCCCTGGTCCAGGCCATCT
TTAGCCGAGATGTGGACGAAGTGCGTTCCCTACTCTCGCAGAAGGAGAACATCAATGTGCTGGACCAAGAGAGGC
GAACTCCATTGCATGCTGCTGCCTACGTAGGCGATGTCCCCATCCTCCAGTTGCTACTGATGTCAGGTGCTAATG
TCAATGCTAAGGACACACTGTGGCTGACCCCTCTTCATCGTGCTGCTGCCTCCCGAAACGAGACGGTGAACCTGC
TCCTCAACAAGGGAGCCAGCCTGAATGTCTGTGACAAAAAGGAGCGGCAGCCTCTGCATTGGGCAGCTTTTCTAG
GGCACTTGGAGGTCCTAAAACTGCTGGTGGCACGGGGAGCAGACCTCGGCTGCAAGGACCGCAAGGGCTATGGGC
TGCTCCATACAGCTGCTGCCAGTGGCCAGATTGAAGTGGTGAAGTACCTGCTTCGGATGGGGAGCGGAGATCGATG
AACCCAATGCTTTTGGAAACACAGCTTTGCACATCGCCTGCTACCTGGGCCAGGATGCTGTGGCTATTGAGCTGG
TGAATGCCGGAGCCAATGTCAACCAGCCGAATGACAAGGGCTTCACGCCACTGCATGTGGCTGCAGTCTCGACCA
ATGGCGCTCTCTGCTTGGAGCTACTGGTTAATAATGGGGCTGACGTCAACTGCCAGAGCAAAGAAGGGAAAAGTC
CTCTGCACATGGCTGCAATCCATGGCCGTTTCACACGCTCCCAGATCCTCATCCAGAATGGCAGCGAGATTGATT
GTGCCGACAAATTTGGGAACACGCCACTGCATGTGGCTGCTCGATATGGACACGAGCTGCTCATCAGCACCCTCA
TGACCAATGGCGCAGATACCGCCCGGCGTGGCATCCATGACATGTTCCCCCTGCACTTAGCTGTTCTCTTTGGAT
TCTCTGACTGTTGTCGTAAGCTTCTTTCCTCAGGTCAGTTGTACAGCATTGTGTCTTCACTCAGCAATGCGCATG
TGCTTTCAGCTGGGTTTGACATCAATACACCTGACAACCTTGGCCCTACCTGTCTTCATGCTGCTGCTTCCGCAG
GGAATGTTGAATGTCTTAATTTGCTGTTGAGCAGTGGAGCTGACTTGAGGAGGAGGGACAAATTTGGCAGGACCC
CACTGCACTATGCAGCTGCTAACGGTAGCTACCAGTGTGCAGTAACATTGGTGACTGCTGGGGCAGGTGTCAACG
AGGCCGACTGTAAAGGCTGCTCTCCCCTCCACTACGCTGCCGCTTCTGACACTTACAGGAGAGCGGAACCCCATA
CACCTTCCAGCCATGATGCCGAAGAGGACGAGCCACTGAAGGAGTCCCGCAGGAAGGAGGCCTTCTTCTGTCTGG
AGTTCTTACTGGATAACGGTGCAGACCCCTCCCTGCGGGACAGGCAGGGCTACACAGCTGTGCACTATGCAGCCG
CCTATGGCAACAGACAGAACCTCGAACTGCTCTTAGAAATGTCCTTTAACTGCCTGGAGGATGTGGAGAGCACCA
TTCCAGTCAGCCCTTTGCACTTAGCTGCCTACAACGGTCACTGTGAAGCCTTGAAGACGCTGGCGGAGACGCTGG
TGAATCTGGACGTAAGGGACCACAAGGGCCGGACCGCACTCTTCCTGGCCACGGAGCGCGGCTCTACTGAGTGTG
TGGAGGTGCTTACAGCCCACGGCGCCTCTGCCCTCATCAAGGAGCGCAAGCGCAAGTGGACACCCCTGCACGCTG
CTGCTGCCTCTGGCCACACTGACTCCCTGCACTTGCTGATCGACAGTGGGGAACGAGCTGACATCACAGATGTCA
TGGATGCCTATGGACAGACCCCACTGATGCTGGCCATCATGAATGGCCATGTGGACTGTGTACATCTGCTGCTAG
AGAAAGGATCCACAGCTGATGCTGCTGACCTCCGGGGCCGCACTGCCCTCCACCGCGGGGCAGTGACTGGCTGTG
AGGACTGCCTGGCTGCCCTGCTGGACCACGACGCATTTGTGCTGTGCCGAGACTTTAAGGGCCGCACGCCCATTC
ACCTGGCCTCAGCCTGTGGCCACACTGCAGTACTGCGGACCCTGCTGCAGGCTGCCCTTTCCACAGATCCCCTGG
ATGCCGGGGTGGATTACAGCGGATACTCGCCCATGCACTGGGCCTCCTACACTGGACATGAAGATTGTCTGGAGT
TGTTACTTGAACACAGCCCGTTTTCGTACCTGGAAGGAAACCCCTTCACTCCTTTGCACTGTGCAGTGATTAATA
ACCAAGACAGCACCACAGAGATGCTACTGGGAGCTCTGGGTGCCAAGATTGTGAACAGCCGAGATGCCAAAGGAC
GGACCCCCCTTCACGCCGCTGCCTTCGCGGACAATGTCTCTGGGCTCCGGATGCTGCTGCAGCATCAAGCTGAGG
TGAACGCCCACTGACCACATTGGCCGCACTGCGCTCATGACGGCGGCTGAGAACGGGCAGACCGCTGCTGTCGAAT
TTCTGCTGTATCGAGGGAAGGCAGACCTTACTGTGTTGGATGAGAACAAGAACACGGCCCTCCACTTGGCTTGTA
GCAAGGGCCATGAGAAATGTGCCCTCATGATCCTGGCAGAAACCCAAGACCTTGGCCTTATCAATGCTACCAACA
GTGCGCTGCAGATGCCACTCCACATTGCTGCCCGGAATGGTCTAGCTTCTGTGGTACAGGCCCTGCTGAGTCATG
GGGCCACAGTGCTGGCTGTGGATGAAGAAGGTGGGTGGGGTCTGGGGCCCCATGCCTCTCTTGGGTTTGGGGTCA
GGGACATTCTTCAGGAGGTGACTTCTTAATCTTGCTATACATGGGATTTTCTTCCCAAGGGAACTCTTCAGAGCA
GGGAGCCCACACCA

The NOV3 protein (SEQ ID NO:6) encoded by SEQ ID NO:5 is 993 amino acid residues in length and is presented using the one-letter amino acid code in Table 3B. The SignalP, Psort and/or Hydropathy results indicate that NOV3 has no known signal peptide and is likely to be localized in the mitochondrial matrix space with a certainty of 0.5083. Alternatively, a NOV3 polypeptide is located to the nucleus with a certainty of 0.3000, the mitochondrial inner membrane with a certainty of 0.2317, or the mitochondrial intermembrane space with a certainty of 0.2217.

TABLE 3B

Encoded NOV3 Protein Sequence (SEQ ID NO: 6)

MESAGPRSPCSRHRSRRLGRSVSPVEPPPPPPGARCGRSPGRAMGILSITDQPPLVQAIFSRDVEEVRSLLSQKE
NINVLDQERRTPLHAAAYVGDVPILQLLLMSGANVNAKDTLWLTPLHRAAASRNETVNLLLNKGASLNVCDKKER
QPLHWAAFLGHLEVLKLLVARGADLGCKDEKGYGLLHTAAASGQIEVVKYLLRMGAEIDEPNAFGNRALHIACYL
GQDAVAIELVNAGANVNQPNDKGFTPLHVAAVSTNGALCLELLVNNGADVNYQSKEGKSPLHMAAIHGRFTRSQI
LIQNGSEIDCADKFGNRPLHVAARYGHELLISRLMTNGADTARRGIHDMFPLHLAVLFGFSDCCRKLLSSGQLYS
IVSSLSNEHVLSAGFDINTPDNLGRTCLHAAASGGNVECLNLLLSSGADLRRRDKFGRTPLHYAAANGSYQCAVT
LVTAGAGVNEADCKGCSPLHYAAASDTYRRAEPHTPSSHDAEEDEPLKESRRKEAFFCLEFLLDNGADPSLRDRQ
GYTAVHYAAAYGNRQNLELLLEMSFNCLEDVESTIPVSPLHLAAYNGHCEALKTLAETLVNLDVRDHKGRTALFL
ATERGSTECVEVLTAHGASALIKERKRKWTPLHAAAASGHTDSLHLLIDSGERADITDVMDAYGQTPLMLAIMNG
HVDCVHLLLEKGSTADAADLRGRTALHRGAVTGCEDCLAALLDHDAFVLCRDFKGRTPIHLASACGHTAVLRTLL
QAALSTDPLDAGVDYSGYSPMHWASYTGHEDCLELLLEHSPFSYLEGNPFTPLHCAVINNQDSTTEMLLGALGAK
IVNSRDAKGRTPLHAAAFADNVSGLRMLLQHQAEVNARDHIGRTALMTAAENGQTAAVEFLLYRGKADLTVLDEN
KNTALHLACSKGHEKCALMILAETQDLGLINATNSALQMPLHIAARNGLASVVQALLSHGATVLAVDEEGGWGLG
PHASLGFGVRDILQEVTS

Included in the invention are variants of the parent clone NOV3 as shown below in Table 3C. These novel variants were derived by laboratory cloning of cDNA fragments coding for a domain of the full length form of NOV3 (CG53400-01), between residues 596 and 968.

TABLE 3C

Variants of NOV3

| NOV3 Variant No. | Alternate Reference | Change in SEQ ID NO: 5 | Change in SEQ ID NO: 6 |
|---|---|---|---|
| 1 | 174228169 | T → C at bp 2644 | I → T at aa 866 |
| 2 | 174228176 | T → C at bp 2144; A → G at bp 2227; and T → C at bp 2644 | D → G at aa 727; and I → T at aa 866 |
| 3 | 174228191 | A → G at bp 2628; and T → C at bp 2644 | N → D at aa 861; and I → T at aa 866 |
| 4 | 174228195 | A → G at bp 2622; and T → C at bp 2644 | E → G at aa 859' and I → T at aa 866 |
| 5 | 174228206 | G → A at bp 2118; and T → C at bp 2644 | D → N at aa 691; and I → T at aa 866 |
| 6 | 174228213 | G → A at bp 1947; G → A at bp 2541; and T → C at bp 2644 | A → T at aa 634 A → T at aa 832; and I → T at aa 866 |

TABLE 3D

PatP Results for NOV3

| Sequences Producing High-Scoring Segment Pairs: | High Score | Smallest Sum Prob P (N) |
|---|---|---|
| patp: AAM39062 Human polypeptide | 2704 | 3.6e−281 |
| patp: AAU28174 Novel human secretory protein | 1932 | 2.3e−199 |
| patp: AAM40848 Human polypeptide | 1621 | 2.1e−166 |
| patp: AAU20496 Human secreted protein | 1287 | 5.2e−131 |
| patp: AAU25428 Human mddt protein from clone LG:893050.1:2000Feb18 | 1045 | 2.3e−105 |

In a BLAST search of public sequence databases, it was found, for example, that the NOV3 nucleic acid sequence of this invention has 1552 of 2369 bases (65%) identical to a gb:GENBANK-ID:HSM801363|acc:AL133087.1 mRNA from *Homo sapiens* mRNA; cDNA DKFZp434D2328 (from clone DKFZp434D2328); partial cds. Further, the full amino acid sequence of the disclosed NOV3 protein of the invention has 498 of 791 amino acid residues (62%) identical to, and 600 of 791 amino acid residues (75%) similar to, the 791 amino acid residue ptnr:SPTREMBL-ACC:Q9UFA4 protein from Human (HYPOTHETICAL 85.6 KDA PROTEIN).

The NOV3 protein of the invention also has homolgy to the proteins shown in the BLASTP data in Table 3E.

TABLE 3E

NOV3 BLASTP Results

| Gene Index/ Identifier | Protein/Organism | Length of aa | Identity (%) | Positives (%) | Expect Value |
|---|---|---|---|---|---|
| Q9UFA4 | HYPOTHETICAL 85.6 KDA PROTEIN–Human | 791 | 498/791 (62%) | 600/791 (75%) | 2.9e−263 |
| O15084 | Hypothetical protein KIAA0379–Human | 1059 | 435/917 (47%) | 577/917 (62%) | 2.9e−199 |
| Q9NCP8 | ANKYRIN 2–*Drosophila melanogaster* (fruit fly) | 1159 | 243/761 (31%) | 357/761 (46%) | 3.5e−70 |
| T42714 | ankyrin 3, splice form 2–mouse | 1765 | 231/761 (30%) | 342/761 (44%) | 8.2e−70 |
| T42715 | ankyrin 3, splice form 3–mouse | 1940 | 231/761 (30%) | 342/761 (44%) | 1.0e−69 |

A search against the Patp database, a proprietary database that contains sequences published in patents and patent publication, yielded several homologous proteins shown in Table 3D.

A multiple sequence alignment is given in Table 3F, with the NOV3 protein of the invention being shown in line 1 in a ClustalW analysis comparing NOV3 with related protein sequences of Table 3E.

Table 3F. ClustalW Analysis of NOV3

1. SEQ ID NO.: 6   NOV3   4. SEQ ID NO.: 139   Q9NCP8

2. SEQ ID NO.: 137   Q9UFA4         5. SEQ ID NO.: 140   T42714
3. SEQ ID NO.: 138   O15084         6. SEQ ID NO.: 141   T42715

```
                    10        20        30        40        50        60
              ....|....|....|....|....|....|....|....|....|....|....|....|
NOV3          MESAGPRSPCSR-----HRSRRLGRSVSPVEPPPPPPGARCGRSPGRAMGILSITDQPP  54
Q9UFA4        ------------------------------------------------------------   1
O15084        ----GAEATAMA------FLKLRDQPSLVQAIFNGDPDEVRALIFKKEDVNFQDNEKRTP  50
Q9NCP8        ---MVTEN---------GAQGDGNTSFLRAARAGNLERVLEHLKNNIDINTSNANGLNA  47
T42714        MSEEPKEKPAKPAHRKRKGKKSDANASYLRAARAGHLEKALDYIKNGVDVNICNQNGLNA  60
T42715        MSEEPKEKPAKPAHRKRKGKKSDANASYLRAARAGHLEKALDYIKNGVDVNICNQNGLNA  60

70        80        90       100       110       120
              ....|....|....|....|....|....|....|....|....|....|....|....|
NOV3          LVQAIFSRDVEEVRSLLSQKENINVLDQERRTPLHAAAYVCDVPILQLLLMSGANVNAKD 114
Q9UFA4        ------------------------------------------------------------   1
O15084        LHAAAYLGDAETIELLILSGARVNAKDSKWLTPLHRAVASCSEEAVQVLLKHSADVNARD 110
Q9NCP8        LHLASKDGHIHVVSELIRRGAIVDSATKKGNTALHIASLAGQEEVVKILLEHNASVNVQS 107
T42714        LHLASKEGHVEVVSELLQREANVDAATKKGNTALHIASLAGQAEVVKVLVTNGANVNAQS 120
T42715        LHLASKEGHVEVVSELLQREANVDAATKKGNTALHIASLAGQAEVVKVLVTNGANVNAQS 120

130       140       150       160       170       180
              ....|....|....|....|....|....|....|....|....|....|....|....|
NOV3          TLWLTPLHRAAAS---R-----------------------N----RTVNLLLNKGA    140
Q9UFA4        ------------------------------------------------------------   1
O15084        KNWQTPLHIAAANKAVKCAEALVPLLSNVNVSDRAGRTALHHAAFSGHGEVVKLLLSRGA 170
Q9NCP8        QNGFTPLYMAAQENHDAVVRLLLSNGANQSLATEDGFTPLAVAMQQGHDKVVAVLLES-- 165
T42714        QNGFTPLYMAAQENHLEVVRFLLDNGASQSLATEDGFTPLAVALQQGHDQVVSLLLEN-- 178
T42715        QNGFTPLYMAAQENHLEVVRFLLDNGASQSLATEDGFTPLAVALQQGHDQVVSLLLEN-- 178

190       200       210       220       230       240
              ....|....|....|....|....|....|....|....|....|....|....|....|
NOV3          SLNVCDKKERQPLHWAAFLGHLEVLKLLVARGADLGCKDRKGYGLLHTAAASGQIEVVKY 200
Q9UFA4        -----------------------------------KRGYTPLHAAASNGQINVVKH     21
O15084        NINAFDKKDRRALHWAAYMGHIEVVKLLVSHGAEVTCKDKKSYTPLHAAASSGMISVVKY 230
Q9NCP8        --DTRGKVRLPALHIAAKKDDVKAATLILDNDHNPDVTSKSGFTPLHIASHYGNQNIANL 223
T42714        --DTKGKVRLPALHIAARKDDTKAAALLLQNDTNADVESKSGFTPLHIAAHYGNINVATL 236
T42715        --DTKGKVRLPALHIAARKDDTKAAALLLQNDTNADVESKSGFTPLHIAAHYGNINVATL 236

250       260       270       280       290       300
              ....|....|....|....|....|....|....|....|....|....|....|....|
NOV3          LLRMGAEIDEPNAFGNTALHIACYLGQDAVAIELVNAGANVNQPNDKGFTPLHVAAVSTN 260
Q9UFA4        LLNLGVEIDEINVYGNTALHIACYNGQDAVVNELIDYGANVNQPNNCGFTPLHFAAASTH  81
O15084        LLDLGVDMNEPNAYGNTPLHVACYNGQDVVVNELIVQKNEKGFTPLHFAAASTH 290
Q9NCP8        LIQKGADVNYSAKHNISPLHVAAKWGKTNVVSLLLEKGGNIEAKTRDGLTPLHCAARSGH 283
T42714        LLNRAAAVDFTARNDITPLHVASKRGNANVVKLLLDRGAKIDAKTRDGLTPLHCGARSGH 296
T42715        LLNRAAAVDFTARNDITPLHVASKRGNANVVKLLLDRGAKIDAKTRDGLTPLHCGARSGH 296

310       320       330       340       350       360
              ....|....|....|....|....|....|....|....|....|....|....|....|
NOV3          GALCLELLVNNGADVNYQSKEGKSPLHMAAIHGRFTRSQLLIQNGSEIDCADKFGNTPLH 320
Q9UFA4        GALCLELLVNNGADVNIQSKDGKSPLHMTAVHGRFTRSQTLIQNGGEIDCVDKDGNTPLH 141
O15084        GALCLELLVGNGADVNMKSKDGKTPLHMTALHGRFSRSQTTLQSGAVIDCEDKNGNTPLH 350
Q9NCP8        -EQVVDMLLERGAPTSAKTKNGLAPLHMAAQGEHVDAARILYHRAPVDEVTVDYLTALH 342
T42714        -EQVVEMLLDRSAPILSKTKNGLSPLHMATQGDHLNCVQLLLQHNPVDDVTNDYLTALH 355
```

```
T42715   -EQVVEMLLDRSAPILSKTKNGLSPLHMATQGDHLNCVQLLQHNVPVDDVTNDYLTALH  355

370       380       390       400       410       420
         ....|....|....|....|....|....|....|....|....|....|....|....|
NOV3     VAARYGHELLISTLMTNGADTARRGIHDMFPLHLAVLFGFSDCCRKLLSSGQLYSIVSSL  380
Q9UFA4   VAARYGHELLINTLITSGADTAKCGIHSMFPLHLAALNAHSDCCRKLLSSGQKYSIVSLF  201
O15084   IAARYGHELLINTLITSGADTAKRGIHGMFPLHLAALSGFSDCCRKLLSSG---------  401
Q9NCP8   VAAHCGHVRVAKLLDRNADANARALNGFTPLHIACKKNRLKVVELLLRHGASISATTES   402
T42714   VAAHCGHYKVAKVLLDKKASPNAKALNGFTPLHIACKKNRIRVMELLLKHGASIQAVTES  415
T42715   VAAHCGHYKVAKVLLDKKASPNAKALNGFTPLHIACKKNRIRVMELLLKHGASIQAVTES  415

430       440       450       460       470       480
         ....|....|....|....|....|....|....|....|....|....|....|....|
NOV3     ---------------SNEHVLSAGFDINTPDNLGRTCLHAAASGCNVECLNLLSSGADL   425
Q9UFA4   ---------------SNEHVLSAGFEIDTPDKFGRTCLHAAAAGGNVECIKLLQSSGADF  246
O15084   -----------------------FDIDTPDDFGRTCLHAAAAGCNLECLNLLLNTGADF  437
Q9NCP8   GLTPLHVAAFMGCMNIVIYLLQHDASPDVPTVRGETPLHLAARANQTDIIRILLRNGAQV  462
T42714   GLTPIHVAAFMGHVNIVSQLMHHGASPNTTNVRGETALHMAARSGQAEVVRYLVQDGAQV  475
T42715   GLTPIHVAAFMGHVNIVSQLMHHGASPNTTNVRGETALHMAARSGQAEVVRYLVQDGAQV  475

490       500       510       520       530       540
         ....|....|....|....|....|....|....|....|....|....|....|....|
NOV3     RRRDKFGRTPLHYAAANGSYQCAVTLVTAGAGVNEADCKGCSPLHYAAASDTYRRAEPHT  485
Q9UFA4   HKKDKCGRTPLHYAAANCHFHCIETLVTTGANVNETDDWGRTALHYAAASDMDRNKTILG  306
O15084   NKKDKFGRSPLHYAAANCNYQCLFALVGSGASVNDLDERGCTPLHYAATSDTDG------  491
Q9NCP8   DARAREQTPLHIAGRLCNVDIVMLLQHGAQVDATTKDMYTALHIAAKEGQDEVAAVLI    522
T42714   EAKAKDDQTPLHISARLGKADIVQQLLQQGASPNAATTSGYTPLHLAAREGHEDVAAFLL  535
T42715   EAKAKDDQTPLHISARLGKADIVQQLLQQGASPNAATTSGYTPLHLAAREGHEDVAAFLL  535

550       560       570       580       590       600
         ....|....|....|....|....|....|....|....|....|....|....|....|
NOV3     PS-----SHDAEEDEPLKESRRKEAFFCLEFLLDNGADPSLRDRQGYTAVHYAAAYGNRQ  540
Q9UFA4   NA-----HDNSEELERARELKEKEATLCLEFLLQNDANPSIRDKEGYNSTHYAAAYCHRQ  361
O15084   -------------------------KCLEYLLRNDANPGIRDKQGYNAVHYSAAYGHRL  525
Q9NCP8   ENGAALDAATKKGFTPLHLTAKYGHIKVAQLLLQKEADVDAQGKNGVTPLHVACHYNNQQ  582
T42714   DHGASLSITTKKGFTPLHVAAKYGKLEVASLLLQKSASPDAAGKSGLTPLHVAAHYDNQK  595
T42715   DHGASLSITTKKGFTPLHVAAKYGKLEVASLLLQKSASPDAAGKSGLTPLHVAAHYDNQK  595

610       620       630       640       650       660
         ....|....|....|....|....|....|....|....|....|....|....|....|
NOV3     NLELLLEMS--------FN--CLEDVESTIPVSPLHLAAYNGHCEALKTLAETLVNLDVR  590
Q9UFA4   CLELLLERT--------NSG--FE-ESDSGATKSPLHLAAYNGHHQALEVLLQSLVDLDIR  411
O15084   CLQLLASETPLDVLMETSGTDMLSDSDNRATISPLHLAAYHGHHQALEVLVQSLLDLDVR  585
Q9NCP8   VALLLLEKG-----------ASPHATAKNGHTPLHIAARKNQMDIATTLLEYGALANAE  630
T42714   VALLLLDQG-----------ASPHAAAKNGYTPLHIAAKKNQMDIATSLLEYGADANAV  643
T42715   VALLLLDQG-----------ASPHAAAKNGYTPLHIAAKKNQMDIATSLLEYGADANAV  643

670       680       690       700       710       720
         ....|....|....|....|....|....|....|....|....|....|....|....|
NOV3     DHKGRTALFLATERCSTECVEVLTAHGASALIKERKRKWTPLHAAAASGHTDSLHLLIDS  650
Q9UFA4   DEKGRTALDLAAFKGHTECVEALINQGASIFVKDNVTKRTPLHASVINGHTLCLRLLLEI  471
O15084   NSSGRTPLDLAAFKGHVECVDVLINQGASILVKDYILKRTPIHAAATNGHSECLRLLIGN  645
Q9NCP8   SKACFTPLPLHLSSQEGHAEISNLLIEHKAAVNHPAK-NGLTPMHLCAQEDNVNVAEILEKN  689
T42714   TRCGIASVHLAAQEGHVDMVSLLLSRNANVNLSNK-SGLTPLHLAAQEDRVNVAEVLVNQ  702
T42715   TRCGIASVHLAAQEGHVDMVSLLLSRNANVNLSNK-SGLTPLHLAAQEDRVNVAEVLVNQ  702

730       740       750       760       770       780
```

```
         .... | .... | .... | .... | .... | .... | .... | .... | .... | .... | .... | .... |
NOV3    GERADITDVMDAYGQTPLMLAIMNGHVDCVHLLLEKGSTADAADLRGRTALHRGAVTGCE 710
Q9UFA4  ADNPEAVDVKDAKGQTPLMLAVANGHIDAVSLLLEKEANVDTVDILGCTALHRGIMTGHE 531
O15084  AEPQNAVDIQDGNGQTPLMLSVLNGHTDCVYSLLNKGANVDAKDKWGRTALHRGAVTGHE 705
Q9NCP8  G---ANTDMATKAGYTPLHVASHTGQANMVRFLLQNGANVDAATSIGYTPLHQTAQQGHC 746
T42714  G---AHVDAQTKMGYTPLHVGCHYGNIKIVNFLLQHSAKVNAKTKNGYTALHQAAQQGHT 759
T42715  G---AHVDAQTKMGYTPLHVGCHYGNIKIVNFLLQHSAKVNAKTKNGYTALHQAAQQGHT 759

790       800       810       820       830       840
         .... | .... | .... | .... | .... | .... | .... | .... | .... | .... | .... | .... |
NOV3    DCLAALLDHDAFVLCRDFKGRTPLHLASAGGHTAVLRTLLQAALSTDPLDA--------- 761
Q9UFA4  ECVQMLLEQEVSILCKDSRGRTPLHYAAARGHATWLSELLQMALSEED-CC--------- 581
O15084  ECVDALLQHGAKCLLRDSRGRTPLHLSAACGHIGVLGALLQSAASMDANPA--------- 756
Q9NCP8  HIVNLLLEHKANANAQTVNGQTPLHIARKLGIISVLDSLKTITKEDETAAAPSQAEEKYR 806
T42714  HIINVLLQNNASPNELTVNGNIALALARRLGYISVVDTLKVVTEEIMTTTT---ITEKHK 816
T42715  HIINVLLQNNASPNELTVNGNIALALARRLGYISVVDTLKVVTEEIMTTTT---ITEKHK 816

850       860       870       880       890       900
         .... | .... | .... | .... | .... | .... | .... | .... | .... | .... | .... | .... |
NOV3    -----------GVDYS-------------------------------------------- 766
Q9UFA4  -----------FKDNQ-------------------------------------------- 586
O15084  -----------TADNH-------------------------------------------- 761
Q9NCP8  VVAPEAMHESF-MSDSE-----------------EEGG-----------------EDNM 830
T42714  MNVPETMNEVLDMSDDEVRKASAPEKLSDGEYISDGEEGDKCTWFKIPKVQEVLVKSEDA 876
T42715  MNVPETMNEVLDMSDD--------------------EGDKCTWFKIPKVQEVLVKSEDA 855

910       920       930       940       950       960
         .... | .... | .... | .... | .... | .... | .... | .... | .... | .... | .... | .... |
NOV3    ------------------------------------------GYSPMHWASYTGHEDCLELL 786
Q9UFA4  ------------------------------------------GYTPLHWACYNGNENCLEVL 606
O15084  ------------------------------------------GYTALHWACYNGHETCVELL 781
Q9NCP8  LSDQPYRYLTVDEMKSLGDDSLPID----VTRDER------MDSNRMTQSAEYASGVPPT 880
T42714  ITGDTDKYLGPQDLKELGDDSLPAEGYVGFSLGARSASLRSPSSDRSYTLNRSSYARDSM 936
T42715  ITGDTDKYLGPQDLKELGDDSLPAEGYVGFSLGARSASLRSPGSDRSYTLNRSSYARDSM 915

970       980       990      1000      1010      1020
         .... | .... | .... | .... | .... | .... | .... | .... | .... | .... | .... | .... |
NOV3    LEHSPFSYLEGNPFTPLHCAVINNQ---------------------DSTTEMLIGALGA 824
Q9UFA4  LEQKCFRKFIGNPFTPLHCAILNDH---------------------GNCASLLIGAIDS 644
O15084  LEQEVFQKTEGNAFSPLHCAVLNDN---------------------EGAAEMLIDTLGA 819
Q9NCP8  IGEEVISPHKTQVIGSSPKATVDGV-YIANGSGHDEPPHVGRKLSWKSFLVSFLVDARGG 939
T42714  MIEELLVPSKEQHLTFTREFDSDSLRHYSWAADTLDNVNLVSSPVHSGFLVSFMVDARGG 996
T42715  MIEELLVPSKEQHLTFTREFDSDSLRHYSWAADTLDNVNLVSSPVHSGFLVSFMVDARGG 975

1030      1040      1050      1060      1070      1080
         .... | .... | .... | .... | .... | .... | .... | .... | .... | .... | .... | .... |
NOV3    KIVNSRDAKGRTPLHAAAFADNVSGLRMLLQHQAEVNATDHI-GRTALMTAAENGQTAAV 883
Q9UFA4  SIVSCRDDKGRTPLHAAAFADHVECLQLLLRHSAPVNAVDNS-GKTALMMAAENGQAGAV 703
O15084  SIVNATDSKGRTPLHAAAFTDHVECLQLLLSHNAQVNSVDST-GKTPLMMAAENGQTNTV 878
Q9NCP8  AMRGCRHSGVRMIIPSRSTCQPTRVTCRYVKPQRTMHPPQLMEGEALASRVLELGPCSTK 999
T42714  SMRGSRHHGMRIIILPPRKCTAPTRITCRLVKRHKLANPPPMVEGEGLASRLVEMGPAGAQ 1056
T42715  SMRGSRHHGMRIIILPPRKCTAPTRITCRLVKRHKLANPPPMVEGEGLASRLVEMGPAGAQ 1035

1090      1100      1110      1120      1130      1140
         .... | .... | .... | .... | .... | .... | .... | .... | .... | .... | .... | .... |
NOV3    EFLLYRGKADLTVLDENKNTALHLACSKGHEKCALMILAETQD--LGLINA--TNSALQM 939
Q9UFA4  DILVNSAQADLTVKDKDLNTPLHLACSKGHEKCALLILDKIQD--ESLINE--KNNALQT 759
```

```
O15084    EMLVSSASAELTLQDNSKNTALHLACSKGHETSALLILEKITD--RNLINA--TNAALQT  934
Q9NCP8    FLGPVVMEVPHFASLRGKERETIILRSDNGETWREHTIDNSEEIIHDVLQQCFEPEELAQ 1059
T42714    FLGPVIVEIPHFGSMRGKERELIVLRSENGETWKEHQFDSKNEDLAELLNG--MDEELDS 1114
T42715    FLGPVIVEIPHFGSMRGKERELIVLRSENGETWKEHQFDSKNEDLAELLNG--MDEELDS 1093

1150       1160       1170       1180       1190       1200
              ....|....|....|....|....|....|....|....|....|....|....|....|
NOV3      PLHIAARNGLASVVQALLSHGATVLAVDEEGG----------------------WGL  974
Q9UFA4    PLHVAARNGLKVVVEELLAKGACVLAVDENGC----------------------      791
O15084    PLHVAARNGLTMVVQELLGKGASVLAVDENGYTPALACAPNKDVADCLALILATMMPVSS  994
Q9NCP8    LEEQAGNIVCRFVTYDFPQYFAVVSRTRQEVHAIG---P------EGGMVSSTVPQVQA 1110
T42714    PEELGTKRICRIITKDFPQYFAVVSRLKQESNQIG---P------EGGILSSTTVPLVQA 1165
T42715    PEELGTKRICRIITKDFPQYFAVVSRLKQESNQIG---P------EGGILSSTTVPLVQA 1144

1210       1220       1230       1240       1250       1260
              ....|....|....|....|....|....|....|....|....|....|....|....|
NOV3      G-PHASLGFGVRDILQEVTS----------------------------------------  993
Q9UFA4    ------------------------------------------------------------  791
O15084    SSPLSSLTFNAINRYTNTSKT-----------VSFEALPIMRNEPSSYCS---------- 1033
Q9NCP8    VFPQGALTKKLKVGLQVN--------------------LFKPR--K------------- 1134
T42714    SFPEGALTKRIRVGLQAQPVPEETVKKILGNKATFSPIVTVEPRRRKFHKPITMTIPVPP 1225
T42715    SFPEGALTKRIRVGLQAQPVPEETVKKILGNKATFSPIVTVEPRRRKFHKPITMTIPVPP 1204

1270       1280       1290       1300       1310       1320
              ....|....|....|....|....|....|....|....|....|....|....|....|
NOV3      ------------------------------------------------------------  993
Q9UFA4    ------------------------------------------------------------  791
O15084    --------------------FNNIGGEQEYLYTDVD------------------------ 1049
Q9NCP8    -----------------------G-VAPEKLRKIS------------------------- 1145
T42714    PSGEGVSNGYKGDATPNLRLLCSITGGTSPAQWEDITGTTPLTFIKDCVSFTTNVSARFW 1285
T42715    PSGEGVSNGYKGDATPNLRLLCSITGGTSPAQWEDITGTTPLTFIKDCVSFTTNVSARFW 1264

1330       1340       1350       1360       1370       1380
              ....|....|....|....|....|....|....|....|....|....|....|....|
NOV3      ------------------------------------------------------------  993
Q9UFA4    ------------------------------------------------------------  791
O15084    --ELNDSDSETY------------------------------------------------ 1059
Q9NCP8    ---VNHVPKKK----------------RFSLIW--------------------------- 1159
T42714    LADCHQVLETVGLASQLYRELICVPYMAKFVVFAKTNDPVESSLRCFCMTDDRVDKTLEQ 1345
T42715    LADCHQVLETVGLASQLYRELICVPYMAKFVVFAKTNDPVESSLRCFCMTDDRVDKTLEQ 1324

1390       1400       1410       1420       1430       1440
              ....|....|....|....|....|....|....|....|....|....|....|....|
NOV3      ------------------------------------------------------------  993
Q9UFA4    ------------------------------------------------------------  791
O15084    ------------------------------------------------------------ 1059
Q9NCP8    ------------------------------------------------------------ 1159
T42714    QENFEEVARSKDIEVLEGKPIYVDCYGNLAPLTKGGQQLVFNFYSFKENRLPFSIKIRDT 1405
T42715    QENFEEVARSKDIEVLEGKPIYVDCYGNLAPLTKGGQQLVFNFYSFKENRLPFSIKIRDT 1384

1450       1460       1470       1480       1490       1500
              ....|....|....|....|....|....|....|....|....|....|....|....|
NOV3      ------------------------------------------------------------  993
Q9UFA4    ------------------------------------------------------------  791
O15084    ------------------------------------------------------------ 1059
Q9NCP8    ------------------------------------------------------------ 1159
T42714    SQEPCGRLSFLKEPKTTKGLPQTAVCNLNITLPAHKKAEKADRRQSFASLALRKRYSYLT 1465
```

```
T42715   SQEPCGRLSFLKEPKTTKGLPQTAVCNLNITLPAHKKAEKADRRQSFASLALRKRYSYLT 1444

1510      1520      1530      1540      1550      1560
              ....|....|....|....|....|....|....|....|....|....|....|....|
NOV3       ------------------------------------------------------------  993
Q9UFA4     ------------------------------------------------------------  791
O15084     ------------------------------------------------------------ 1059
Q9NCP8     ------------------------------------------------------------ 1159
T42714     EPSMSPQSPCERTDIRMAIVADHLGLSWTELARELNFSVDEINQIRVENPNSLISQSFML 1525
T42715     EPSMSPQSPCERTDIRMAIVADHLGLSWTELARELNFSVDEINQIRVENPNSLISQSFML 1504

1570      1580      1590      1600      1610      1620
              ....|....|....|....|....|....|....|....|....|....|....|....|
NOV3       ------------------------------------------------------------  993
Q9UFA4     ------------------------------------------------------------  791
O15084     ------------------------------------------------------------ 1059
Q9NCP8     ------------------------------------------------------------ 1159
T42714     LKKWVTRDGKNATTDALTSVLTKINRIDIVTLLEGPIFDYGNISGTRSFADENNVFHDPV 1585
T42715     LKKWVTRDGKNATTDALTSVLTKINRIDIVTLLEGPIFDYGNISGTRSFADENNVFHDPV 1564

1630      1640      1650      1660      1670      1680
              ....|....|....|....|....|....|....|....|....|....|....|....|
NOV3       ------------------------------------------------------------  993
Q9UFA4     ------------------------------------------------------------  791
O15084     ------------------------------------------------------------ 1059
Q9NCP8     ------------------------------------------------------------ 1159
T42714     D----------------------------------------------------------- 1586
T42715     DGHPSFQVELETPMGLYWTPPNPFQQDDHFSDISSIESPFRTPSRLSDGLVPSQGNIEHP 1624

1690      1700      1710      1720      1730      1740
              ....|....|....|....|....|....|....|....|....|....|....|....|
NOV3       ------------------------------------------------------------  993
Q9UFA4     ------------------------------------------------------------  791
O15084     ------------------------------------------------------------ 1059
Q9NCP8     ------------------------------------------------------------ 1159
T42714     ------------------------------------------------------------ 1586
T42715     TGGPPVVTAEDTSLEDSKMDDSVTVTDPADPLDVDESQLKDLCQSECAQCWASVPGIPND 1684

1750      1760      1770      1780      1790      1800
              ....|....|....|....|....|....|....|....|....|....|....|....|
NOV3       ------------------------------------------------------------  993
Q9UFA4     ------------------------------------------------------------  791
O15084     ------------------------------------------------------------ 1059
Q9NCP8     ------------------------------------------------------------ 1159
T42714     ------------------------------------------------------------ 1586
T42715     GRQAEPLRPQTRKVGMSSEQQEKGKSGPDEEVTEDKVKSLFEDIQLEEVEAEEMTEDQGQ 1744

1810      1820      1830      1840      1850      1860
              ....|....|....|....|....|....|....|....|....|....|....|....|
NOV3       ------------------------------------------------------------  993
Q9UFA4     ------------------------------------------------------------  791
O15084     ------------------------------------------------------------ 1059
Q9NCP8     ------------------------------------------------------------ 1159
T42714     -----------------GWQNETPSGSLESPAQARRLTGGLLDRLDDSSDQARDSITSYL 1629
T42715     AMLNRVQRAELAMSSLAGWQNETPSGSLESPAQARRLTGGLLDRLDDSSDQARDSITSYL 1804

1870      1880      1890      1900      1910      1920
```

```
           ....|....|....|....|....|....|....|....|....|....|....|....|
NOV3    ------------------------------------------------------------  993
Q9UFA4  ------------------------------------------------------------  791
O15084  ------------------------------------------------------------ 1059
Q9NCP8  ------------------------------------------------------------ 1159
T42714  TGEPGKIEANGNHTAEVIPEAKAKPYFPESQNDIGKQSIKENLKPKTHGCGRTEEPVSPL 1689
T42715  TGEPGKIEANGNHTAEVIPEAKAKPYFPESQNDIGKQSIKENLKPKTHGCGRTEEPVSPL 1864

1930      1940      1950      1960      1970      1980
           ....|....|....|....|....|....|....|....|....|....|....|....|
NOV3    ------------------------------------------------------------  993
Q9UFA4  ------------------------------------------------------------  791
O15084  ------------------------------------------------------------ 1059
Q9NCP8  ------------------------------------------------------------ 1159
T42714  TAYQKSLEETSKLVIEDAPKPCVPVGMKKMTRTTADGKARLNLQEEEGSTRSEPKQGEGY 1749
T42715  TAYQKSLEETSKLVIEDAPKPCVPVGMKKMTRTTADGKARLNLQEEEGSTRSEPKQGEGY 1924

1990
           ....|....|....|.
NOV3    ----------------  993
Q9UFA4  ----------------  791
O15084  ---------------- 1059
Q9NCP8  ---------------- 1159
T42714  KVKTKKEIRNVEKKTH 1765
T42715  KVKTKKEIRNVEKKTH 1940
```

The presence of identifiable domains in the disclosed NOV3 protein was determined by using Pfam and then determining the Interpro number. The results are listed in Table 3G with the statistics and domain description.

TABLE 3G

Domain Analysis of NOV3

| PSSMs Producing Significant Alignments | Score (bits) | E Value |
|---|---|---|
| ank: domain 2 of 26, from 83 to 115 | 40.4 | 4e-08 |
| ANK    dGrTPLHlAarnGhlevvklLLeaGAdvnardk<br>         + +\|\|\|\| \|++ \|++ ++++\|\|  \|\|++++++<br>NOV3  ERRTPLHAAAYVGDVPILQLLLMSGANVNAKDT | (SEQ ID NO:142)<br><br>(SEQ ID NO:6) | |
| ank: domain 11 of 26, from 398 to 430 | 42.2 | 1.2e-08 |
| ANK    dGrTPLHlAarnGhlevvklLLeaGAdvnardk<br>        \|+\|+\|\| \|++ \|+++++ +\|\|+ \|\|++  +++<br>NOV3  LGRTCLHAAASGGNVECLNLLLSSGADLRRRDK | (SEQ ID NO:143)<br><br>(SEQ ID NO:6) | |

Consistent with other known members of the 85.6 kDa family of proteins, NOV3 contains ankyrin domains as illustrated in Table 3G.

The NOV3 nucleic acid, and the encoded polypeptide, according to the invention are useful in a variety of applications and contexts. For example, NOV3 nucleic acids and polypeptides can be used to identify proteins that are members of the ankyrin family of proteins. The NOV3 nucleic acids and polypeptides can also be used to screen for molecules, which inhibit or enhance NOV3 activity or function. Specifically, the nucleic acids and polypeptides according to the invention may be used as targets for the identification of small molecules that modulate or inhibit, e.g., red blood cell formation/organization, or signal transduction/cell activation. These molecules can be used to treat, e.g., spherocytosis.

In addition, the NOV3 nucleic acid and polypeptide according to the invention are useful, inter alia, as novel members of the protein families according to the presence of domains and sequence relatedness to previously described proteins. For example, the NOV3 nucleic acid and polypeptide include structural motifs that are characteristic of proteins belonging to the family of transmembrane proteins/membrane skeleton proteins such as the ankyrin proteins. Ankyrin is a globular protein (200 kD) that links spectrin and an integral membrane protein (Band III) in the erythrocyte plasma membrane. Ankyrin belongs to a family of closely related polypeptides associated with the plasma membrane of cells in a variety of cell types (e.g. lymphocytes, platelets, fibroblasts and endothelial tissues). Ankyrin has been shown to underlie membrane proteins including CD44, the voltage-dependent sodium channel, NA+/K+ ATPase and the anion exchanger protein. Functional diversity between members of the ankyrin family is generated by the expression of multiple genes as well as alternative splicing of pre-mRna's. The formation of a direct connection between ankyrin and functionally important transmembrane proteins/membrane skeleton may be one of the earliest events to occur during signal transduction and cell activation.

The NOV3 nucleic acid and polypeptide, antibodies and related compounds according to the invention will be useful in therapeutic and diagnostic applications in the mediation of signal transduction or cell activation. As such the NOV3 nucleic acid and polypeptide, antibodies and related compounds according to the invention may be used to treat genetic conditions, e.g., endometriosis, fertility, adrenoleukodystrophy, congenital adrenal hyperplasia, diabetes, Von Hippel-Lindau (vhl) syndrome, pancreatitis, obesity, hyperparathyroidism, hypoparathyroidism, hyperthyroidism, hypothyroidism, SIDS, xerostomia, scleroderma, hypercalceimia, ulcers, cirrhosis, transplantation, inflammatory bowel disease, diverticular disease, hirschsprung's disease, crohn's disease, appendicitis, hemophilia, hypercoagulation, idiopathic thrombocytopenic purpura, autoimmume disease, allergies, immunodeficiencies, graft vesus host, anemia, ataxia-telangiectasia, lymphedema, tonsilitis, osteoporosis, hypercalceimia, arthritis, ankylosing spondylitis, scoliosis, tendinitis, muscular dystrophy, lesch-nyhan syndrome, myasthenia gravis, dental disease and infection, cardiomyopathy, atherosclerosis, hypertension, congenital heart defects, aortic stenosis, atrial septal defect (asd), atrioventricular (a-v) canal defect, ductus arteriosus, pulmonary stenosis, subaortic stenosis, ventricular septal defect (vsd), valve diseases, tuberous sclerosis, aneurysm, fibromuscular dysplasia, stroke, bleeding disorders, alzheimer's disease, parkinson's disease, huntington's disease, cerebral palsy, epilepsy, multiple sclerosis, ataxia-telangiectasia, leukodystrophies, behavioral disorders, addiction, anxiety, pain, neuroprotection, endocrine dysfunctions, growth and reproductive disorders, cystitis, incontinence, renal artery stenosis, interstitial nephritis, glomerulonephritis, polycystic kidney disease, systemic lupus erythematosus, renal tubular acidosis, iga nephropathy, or vesicoureteral reflux.

The NOV3 nucleic acid and polypeptide are useful for detecting specific cell types. For example, expression analysis has demonstrated that a NOV3 nucleic acid is expressed in adrenal gland/suprarenal gland, bone, brain, cartilage, cervix, coronary artery, platelets, kidney, kidney cortex, liver, mammary gland/breast, pancreas, placenta, salivary glands, spleen, synovium/synovial membrane, thymus, cerebral medulla/cerebral white matter, and left cerebellum.

Additional utilities for the NOV3 nucleic acid and polypeptide according to the invention are disclosed herein.

NOV4

The NOV4 proteins descibed herein are novel myotonic dystrophy kinase-related CDC42 binding kinase (MRCK)-like proteins. The NOV4 nucleic acids disclosed herein map to chromosome 11q13. Two alternative novel NOV4 nucleic acids and NOV4 polypeptides are disclosed herein, namely NOV4a and NOV4b.

NOV4a

A NOV4 variant is NOV4a (alternatively referred to herein as CG56209-01), which encodes the 3835 nucleotide sequence (SEQ ID NO:7) shown in Table 4A. An open reading frame for the mature protein was identified beginning with an ATG codon at nucleotides 98–100 and ending with a TAG codon at nucleotides 3689–3691. Putative untranslated regions, if any, downstream from the termination codon and upstream from the initiation codon are underlined. The start and stop codons are in bold letters.

The NOV4a protein (SEQ ID NO:8) encoded by SEQ ID NO:7 is 1197 amino acid residues in length and is presented using the one-letter amino acid code in Table 4B. The SignalP, Psort and/or Hydropathy results indicate that NOV4a has no known signal peptide and is likely to be localized in the nucleus with a certainty of 0.7600. Alternatively, a NOV4a polypeptide is located to the microbody (peroxisome) with a certainty of 0.3114, the lysosome (lumen) with a certainty of 0.1772, or the mitochondrial matrix space with a certainty of 0.1000.

TABLE 4A

NOV4a Nucleotide Sequence (SEQ ID NO: 7)

<u>CGGACAGAGCCTCAGACGGTTGGGCGGACGGACGGCCCCACAGGCGGGCATGCGGGCGGCCAGACTGTAGCCGAG
CAGCGAGGCTCCGGCCGCAGCC</u>ATGGAGCGGCGGCTGCGCGCGCTGGAGCAGCTGGCGCGGGGCGAGGCCGGCGG
CTGCCCGGGGCTCGACGGCCTCCTAGATCTGCTGCTGGCGCTGCACCACGAGCTCAGCAGCGGCCCCCTACGGCG
GGAGCGCAGCGTGGCGCAGTTCCTGAGCTGGGCCAGCCCCTTCGTATCAAAGGTGAAAGAACTGCGTCTGCAGAG
AGATGACTTTGAGATCTTGAAGGTGATCGGCCGAGGAGCCTTTGGGGAGGTCACCGTGGTGAGGCAGAGGGACAC
TGGGCAGATTTTTGCCATGAAAATGCTGCACAAGTGGGAGATGCTGAAGAGGGCTGAGACAGCCTGTTTCCGGGA
GGAGCGGGATGTGCTCGTGAAAGGGGACAGCCGTTGGGTGACCACTCTGCACTATGCCTTCCAAGACGAGGAGTA
CCTGTACCTTGTGATGGACTACTATGCTGGTGGGGACCTCCTGACGCTGCTGAGCCGCTTCGAGGACCGTCTCCC
GCCCGAGCTGGCCCAGTTCTACCTGGCTGAGATGGTGCTGGCCATCCACTCGCTGCACCAGCTGGGTTATGTCCA
CAGGGATGTCAAGCCAGACAACGTCCTGCTGGATGTGAACGGGCACATTCGCCTGGCTGACTTCGGCTCCTGCCT
GCGTCTCAACACCAACGGCATGGTGGATTCATCAGTGGCAGTAGGGACGCCGGACTATATCTCCCCTGAGATCCT
GCAGGCCATGGAGGAGGGCAAGGGCCACTACGGCCCACAGTGTGACTGGTGGTCGCTTGGAGTCTGCGCCTATGA
GCTGCTCTTTGGGGAGACGCCCTTCTATGCTGAGTCCTTGGTGGAAACCTACGGCAAGATCATGAACCACGAGGA
CCACCTGCAGTTCCCCCCGGACGTGCCTGACGTGCCAGCCAGCGCCCAAGACCTGATCCGCCAGCTGCTGTGTCG
CCAGGAAGAGCGGCTAGGCCGTGGTGGGCTGGATGACTTCCGGAACCATCCTTTCTTCGAAGGCGTGGACTGGGA
GCGGCTGGCGAGCAGCACGGCCCCCTATATTCCTGAGCTGCGGGGACCCATGGACACCTCCAACTTTGATGTGGA
TGACGACACCCTCAACCATCCAGGGACCCTGCCACCGCCCTCCCACGGGGCCTTCTCCGGCCATCACCTGCCATT
CGTGGGCTTCACCTACACCTCAGCTTGGGCTGCCCTGGAGCGGAAGCTCCAGTGTCTGGAGCAGGAGAAGCTCCC
AGCTGGAGGAAGCCCGCAACTGAGGAAGGAGGTGGCCGCCCTGCGAGAGCAGCTGGAGCAGGCCCACAGCCACAG
GCGTCTGCAGGAGGCCGAGAAGCAGAGCCAGGCCCTGCAACAGGAGCTCGCCATGCTGCGGGAGGAGCTGGAGCA
GGAGAGCAAGCAGCGGCTGGAGGGTGAGCGGCGGGAGACGGAGAGCAACTGGGAGGCCCAGCTCGCCGACATCCT
CAGCTGGGTGAATGATGAGAAGGTCTCAAGAGGCTACCTGCAGGCCCTGGCCACCAAGATGGCAGAGGAGCTGGA
GTCCTTGAGGAACGTAGGCACCCAGGACCACCAGTGGAAGGCGCGGCGACTGCAGAAGATGGAGGCCTCGGCCAG
GCTGGAGCTGCAGTCAGCGCTGGAGGCCGAGATCCGCGCCAAGCAGGGCCTGCAGGAGCGGCTGACACAGGTGCA
GGAGGCCCAGCTGCAGGCTGAGGGCTGTCCCCCTCCCCAGCCCGGCTCACACACGCTGCGCCCCCGGAGCTTCCC
ATCCCCGACCAAGTGTCTCCGCTGCACCTCGCTGATGCTGGGCCTGGGCCGCCAGGGCCTGGGTTGTGATTGCGG
CTACTTTTGTCACACAACCTGTGCCCCACAGGCCCCACCCTGCCCCGTGCCCCCTGACCTCCTCCGCACAGCCCT
GGGAGTACACCCCGAAACAGGCACAGGCACTGCCTATGAGGGCTTTCTGTCAGGTGTCCGGCGGGGCTGGCAGCG
CGTGTTTGCTGCCCTGAGTGACTCACGCCTGCTGCTGTTTGACGCCCCTGACCTGAGGCTCAGCCCGCCCAGTGG
GGCCCTCCTGCAGGTCCTAGATCTGAGGGACCCCCAGTTCTCGGCTACCCCTGTCCTGGCCTCTGATGTTATCCA
TGCCCAATCCAGGGACCTGCCACGCATCTTTAGGGTGACAACCTCCCAGCTGGCAGTGCCGCCCACCACGTGCAC
TGTGCTGCTGCTGGCAGAGAGCGAGGGGGAGCGGGAACGCTGGCTGCAGGTGCTGGGTGAGCTGCAGCGGCTGCT
GCTGGACGCGCGGCCAAGACCCCGGCCCGTGTACACACTCAAGGAGGCTTACGACAACGGGCTGCCGCTGCTGCC
TCACACGCTCTGCGCTGCCATCCTCGACCAGGATCGACTTGCGCTTGGCACCGAGGAGGGGCTCTTTGTCATCCA
TCTGGACATCTTCCAGGTGGGGGAGTGCCGGCGCGTGCAGCAGCTGACCTTGAGCCCCAGTGCAGGCCTGCTGGT
CGTGCTGTGTGGCCGCGGCCCCAGCGTGCGTCTCTTTGCCCTGGCGGAGCTGGAGAACATAGAGGTAGCAGGTGC
CAAGATCCCCGAGTCTCGAGGCTGCCAGGTGCTGGCAGCTGGAAGCATCCTGCAGGCCCGCACCCCGGTGCTCTG
TGTAGCCGTCAAGCGCCAGGTGCTCTGCTACCAGCTGGGCCCGGGCCTGGGCCTGGCAGCGCCGCATCCGTGA
GCTGCAGGCACCTGCCACTGTGCAGAGCCTGGGGCTGCTGGGGCGACCGGCTATGTGTGGGCGCCGCCGGTGGCTT
TGCACTCTACCCGCTGCTCAACGAGGCTGCGCCGTTGGCGCTGGGGGGCCGGTTTGGTGCCTGAGGAGCTGCCACC
ATCCCGCGGGGCCTGGGTGAGGCACTGGGTGCCGTGGAGCTTAGCCTCAGCGAGTTCCTGCTACTCTTCACCAC
TGCTGGCATCTACGTGGATGGCGCAGGCCGCAAGTCTCTGTTCAGCGAGAACTCCATCGATGTGTTTGACGTGAG
GAGGGCAGAATGGGTGCAGACCGTGCCGCTCAAGAAGGTGCGGCCCCTCAATCCAGAGGGCTCCCTGTTCCTCTA
CGGCACCGAGAAGGACGAGTTCGACATCCCGGACCTCACCGACAACAGCCGGCGCCAGCTGTTCCGCACCAAGAG
CAAGCGCCGCTTCTTTTTCCGCGTGTCGGAGGAGCAGCAGAAGCAGCAGCGCAGGGAGATGCTGAAGGACCCTTT
TGTGCGCTCCAAGCTCATCTCGCCGCCTACCAACTTCAACCACCTAGTACACGTGGGCCCTGCCAACGGGCGGCC
CGGCGCCAGGGACAAGTCCCCGGTTAGTCCTGCTCCAGAATTTGGAAATCCTAGTTTCCTCTCCTTCGTATCCCG
AGTCTGGGACACAAAACTCCGCCCCCAGCCTCTGAGCATCCTGAGCCCGCCCTCTTCCTGACGAAACTGGCCCC
GGATCAGAGCAGGACCTCCCTTACGCCACTGCACTCCAGCCTGGCCGACAGCAAGAGTCTGTCTCCCTCCTCCAC
TCCCCATGAGCCCTAG<u>GACGGGTCACTCATCCTCTCAGAGCCTCAGTTCCCAGCCCTGGAGGGAGATGAGGTTTC
CCAGCCCCACAGGGCTGTTGTGAGGCTGACGTGCCCTCATGGCCAAGGGCTGTCTGTAGCCTGGCCCCCGTATCC
TCTTGGGGTT</u>

TABLE 4B

Encoded NOV4a Protein Sequence (SEQ ID NO: 8)

MERRLRALEQLARGEAGGCPGLDGLLDLLLALHHELSSGPLRRERSVAQFLSWASPFVSKVKELRLQRDDFEILK
VIGRGAFGEVTVVRQRDTGQIFAMKMLHKWEMLKRAETACFREERDVLVKGDSRWVTTLHYAFQDEEYLYLVMDY
YAGGDLLTLLSRFEDRLPPELAQFYLAEMVLAIHSLHQLGYVHRDVKPDNVLLDVNGHIRLADFGSCLRLNTNGM
VDSSVAVGTPDYISPEILQAMEEGKGHYGPQCDWWSLGVCAYELLFGETPFYAESLVETYGKIMNHEDHLQFPPD
VPDVPASAQDLIRQLLCRQEERLGRGGLDDFRNHPFFEGVDWERLASSTAPYIPELRGPMDTSNFDVDDDTLNHP
GTLPPPSHGAFSGHHLPFVGFTYTSAWAALERKLQCLEQEKLPAGGSPQLRKEVAALREQLEQAHSHRRLQEAEK
QSQALQQELAMLREELEQESKQRLEGERRETESNWEAQLADILSWVNDEKVSRGYLQALATKMAEELESLRNVGT
QDHQWKARRLQKMEASARLELQSALEAEIRAKQGLQERLTQVQEAQLQAEGCPPPQPGSHTLRPRSFPSPTKCLR
CTSLMLGLGRQGLGCDCGYFCHTTCAPQAPPCPVPPDLLRTALGVHPETGTGTAYEGFLSGVRRGWQRVFAALSD
SRLLLFDAPDLRLSPPSGALLQVLDLRDPQFSATPVLASDVIHAQSRDLPRIFRVTTSQLAVPPTTCTVLLLAES
EGERERWLQVLGELQRLLLDARPRPRPVYTLKEAYDNGLPLLPHTLCAAILDQDRLALGTEEGLFVIHLDIFQVG
ECRRVQQLTLSPSAGLLVVLCGRGPSVRLFALAELENIEVAGAKIPESRGCQVLAAGSILQARTPVLCVAVKRQV
LCYQLGPGPGPWQRRIRELQAPATVQSLGLLGDRLCVGAAGGFALYPLLNEAAPLALGAGLVPEELPPSRGGLGE
ALGAVELSLSEFLLLFTTAGIYVDGAGRKSLFSENSIDVFDVRRAEWVQTVPLKKVRPLNPEGSLFLYGTEKDEF
DIPDLTDNSRRQLFRTKSKRRFFFRVSEEQQKQQRREMLKDPFVRSKLISPPTNFNHLVHVGPANGRPGARDKSP
VSPAPEFGNPSFLSFVSRVWDTKLRPQPMSILSPALFLTKLAPDQSRTSLTPLHSSLADSKSLSPSSTPHEP

SNP variants of NOV4a are disclosed in Example 2.

NOV4b

Alternatively, a NOV4 variant is NOV4b (alternatively referred to herein as CG5620902), which includes the 3985 nucleotide sequence (SEQ ID NO:9) shown in Table 4C. An open reading frame for the mature protein was identified beginning with an ATG codon at nucleotides 98–100 and ending with a TAG codon at nucleotides 3839–3841. Putative untranslated regions, if any, downstream from the termination codon and upstream from the initiation codon are underlined. The start and stop codons are in bold letters.

TABLE 4C

NOV4b Nucleotide Sequence (SEQ ID NO: 9)

CGGACAGAGCCTCAGACGGTTGGGCGGACGGACGGCCCGACAGGCGGGCATGCGGGCGGCCAGACTGTAGCCGAG
CAGCGAGGCTCCGGCCGCAGCCATGGAGCGGCGGCTGCGCGCGCTGGAGCAGCTGGCGCGGGGCGAGGCCGGCGG
CTGCCCGGGGCTCGACGGCCTCCTAGATCTGCTGCTGGCGCTGCACCACGAGCTCAGCAGCGGCCCCCTACGGCG
GGAGCGCAGCGTGGCGCAGTTCCTGAGCTGGGCCAGCCCCTTCGTATCAAAGGTGAAAGAACTGCGTCTGCAGAG
AGATGACTTTGAGATCTTGAAGGTGATCGGCCGAGGAGCCTTTGGGGAGGTCACCGTGGTGAGGCAGAGGGACAC
TGGGCAGATTTTTGCCATGAAAATGCTGCACAAGTGGGAGATGCTGAAGAGGGCTGAGACAGCCTGTTTCCGGGA
GGAGCGGGATGTGCTCGTGAAAGGGGACAGCCGTTGGGTGACCACTCTGCACTATGCCTTCCAAGACGAGGAGTA
CCTGTACCTTGTGATGGACTACTATGCTGGTGGGGACCTCCTGACGCTGCTGAGCCGCTTCGAGGACCGTCTCCC
GCCCGAGCTGGCCCAGTTCTACCTGGCTGAGATGGTGCTGGCCATCCACTCGCTGCACCAGCTGGGTTATGTCCA
CAGGGATGTCAAGCCAGACAAGGTCCTGCTGGATGTGAACGGGCACATTCGCCTGGCTGACTTCGGCTCCTGCCT
GCGTCTCAACACCAACGGCATGGTGGATTCATCAGTGGCAGTAGGGACGCCGGACTATATCTCCCCTGAGATCCT
GCAGGCCATGGAGGAGGGCAAGGGCCACTACGGCCCACAGTGTGACTGGTGGTCGCTTGGAGTCTGCGCCTATGA
GCTGCTCTTTGGGGAGACGCCCTTCTATGCTGAGTCCTTGGTGGAAACCTACGGCAAGATCATGAACCACGAGGA
CCACCTGCAGTTCCCCCCGGACGTGCCTGACGTGCCAGCCAGCGCCCAAGACCTGATCCGCCAGCTGCTGTGTCG
CCAGGAAGAGCGGCTAGGCCGTGGTGGGCTGGATGACTTCCGGAACCATCCTTTCTTCGAAGGCGTGGACTGGGA
GCGGCTGGCGAGCAGCACGGCCCCCTATATTCCTGAGCTGCGGGGACCCATGGACACCTCCAACTTTGATGTGGA
TGACGACACCCTCAACCATCCAGGGACCCTGCCACCGCCCTCCCACGGGGCCTTCTCCGGCCATCACCTGCCATT
CGTGGGCTTCACCTACACCTCAGCTTGGGCTGCCCTGGAGCGGAAGCTCCAGTGTCTGGAGCAGGAGAAGCTCCC
AGCTGGAGGAAGCCCGCAACTGAGGAAGGAGGTGGCCGCCCTGCGAGAGCAGCTGGAGCAGGCCCACAGCCACAG
GCGTCTGCAGGAGGCCGAGAAGCAGAGCCAGGCCCTGCAACAGGAGCTCGCCATGCTGCGGGAGGAGCTGGAGCA
GGAGAGCAAGCAGCGGCTGGAGGGTGAGCGGCGGGAGACGGAGAGCAACTGGGAGGCCCAGCTCGCCGACATCCT
CAGCTGGGTGAATGATGAGAAGGTCTCAAGAGGCTACCTGCAGGCCCTGGCCACCAAGATGGCAGAGGAGCTGGA
GTCCTTGAGGAACGTAGGCACCCAGGACCACCAGTGGAAGGCGCGGCGACTGCAGAAGATGGAGGCCTCGGCCAG
GCTGGAGCTGCAGTCAGCGCTGGAGGCCGAGATCCGCGCCAAGCAGGGCCTGCAGGAGCGGCTGACACAGGTGCA
GGAGGCCCAGCTGCAGGCTGAGGGCTGTCCCCCTCCCCAGCCCGGCTCACACACGCTGCGCCCCCGGAGCTTCCC
ATCCCCGACCAAGTGTCTCCGCTGCACCTCGCTGATGCTGGGCCTGGGCCGCCAGGGCCTGGGTTGTGATTGCGG

TABLE 4C-continued

NOV4b Nucleotide Sequence (SEQ ID NO: 9)

CTACTTTTGTCACACAACCTGTGCCCCACAGGCCCCACCCTGCCCCGTGCCCCCTGACCTCCTCCGCACAGCCCT
GGGAGTACACCCCGAAACAGGCACAGGCACTGCCTATGAGGGCTTTCTGTCAGGTGTCCGGCGGGGCTGGCAGCG
CGTGTTTGCTGCCCTGAGTGACTCACGCCTGCTGCTGTTTGACGCCCCTGACCTGAGGCTCAGCCCGCCCAGTGG
GGCCCTCCTGCAGGTCCTAGATCTGAGGGACCCCCAGTTCTCGGCTACCCCTGTCCTGGCCTCTGATGTTATCCA
TGCCCAATCCAGGGACCTGCCACGCATCTTTAGGGTGAGTGCCTGGTCCCAGCTGGCAGTGCCGCCCACCACGTG
CACTGTGCTGCTGCTGGCAGAGAGCGAGGGGGAGCGGGAACGCTGGCTGCAGGTGCTGGGTGAGCTGCAGCGGCT
GCTGCTGGACGCGCGGCCAAGACCCCGGCCCGTGTACACACTCAAGGAGGCTTACGACAACGGGCTGCCGCTGCT
GCCTCACACGCTCTGCGCTGCCATCCTCGACCAGGATCGACTTGCGCTTGGCACCGAGGAGGGGCTCTTTGTCAT
CCATCTGGACATCTTCCAGGTGGGGGAGTGCCGGCGCGTGCAGCAGCTGACCTTGAGCCCCAGTGCAGGCCTGCT
GGTCGTGCTGTGTGGCCGCGGCCCCAGCGTGCGTCTCTTTGCCCTGGCGGAGCTGGAGAACATAGAGGTAGCAGG
TGCCAAGATCCCCGAGTCTCGAGGCTGCCAGGTGCTGGCAGCTGGAAGCATCCTGCAGGCCCGCACCCCGGTGCT
CTGTGTAGCCGTCAAGCGCCAGGTGCTCTGCTACCAGCTGGGCCCGGGCCCTGGGCCCTGGCAGCGCCGCATCCG
TGAGCTGCAGGCACCTGCCACTGTGCAGAGCCTGGGGCTGCTGGGCGACCGGCTATGTGTGGGCGCCGCCGGTGG
CTTTGCACTCTACCCGCTGCTCAACGAGGCTGCGCCGTTGGCGCTGGGGGCCGGTTTGGTGCCTGAGGAGCTGCC
ACCATCCCGCGGGGGCCTGGGTGAGGCACTGGGTGCCGTGGAGCTTAGCCTCAGCGAGTTCCTGCTACTCTTCAC
CACTGCTGGCATCTACGTGGATGGCGCAGGCCGCAAGTCTCGTGGCCACGAGCTGTTGTGGCCAGCAGCGCCCCC
TGGCGTGCCCGCAGGGTATGCGGCCCCCTACCTGACAGTGTTCAGCGAGAACTCCATCGATGTGTTTGACGTGAG
GAGGGCAGAATGGGTGCAGACCGTGCCGCTCAAGAAGGTGAGGGTCCGCCAGAGCCCTGGGCTGCCTCAGGTGCG
GCCCCTCAATCCAGAGGGCTCCCTGTTCCTCTACGGCACCGAGAAGGTCCGCCTGACCTACCTCAGGAACCAGCT
GGCAGGTGAGGGAGACGAGTTCGACATCCCGGACCTCACCGACAACAGCCGGCGCCAGCTGTTCCGCACCAAGAG
CAAGCGCCGCTTCTTTTTCCGCGTGTCGGAGGAGCAGCAGAAGCAGCAGCGCAGGGAGATGCTGAAGGACCCTTT
TGTGCGCTCCAAGCTCATCTCGCCGCCTACCAACTTCAACCACCTAGTACACGTGGGCCCTGCCAACGGGCGGCC
CGGCGCCAGGGACAAGTCCCCGGTTAGTCCTGCTCCAGAATTTGGAAATCCTAGTTTCCTCTCCTTCGTATCCCG
AGTCTGGGACACAAAACTCCGCCCCCAGCCTATGAGCATCCTGAGCCCCGCCCTCTTCCTGACGAAACTGGCCCC
GGATCAGAGCAGGACCTCCCTTACGCCACTGCACTCCAGCCTGGCCGACAGCAAGAGTCTGTCTCCCTCCTCCAC
TCCCCATGAGCCCTAGGACGGGTCACTCATCCTCTCAGAGCCTCAGTTCCCAGCCCTGGAGGGAGATGAGGTTTC
CCAGCCCCACAGGGCTGTTGTGAGGCTGACGTGCCCTCATGGCCAAGGGCTGTCTGTAGCCTGGCCCCCGTATCC
TCTTGGGGTT

The NOV4b protein (SEQ ID NO:10) encoded by SEQ ID NO:9 is 1247 amino acid residues in length and is presented using the one-letter amino acid code in Table 4D. The SignalP, Psort and/or Hydropathy results indicate that NOV4b has no known signal peptide and is likely to be localized in the nucleus with a certainty of 0.8800. Alternatively, a NOV4b polypeptide is located to the microbody (peroxisome) with a certainty of 0.3226, the lysosome (lumen) with a certainty of 0.1925, or the mitochondrial matrix space with a certainty of 0.1000.

TABLE 4D

Encoded NOV4b Protein Sequence (SEQ ID NO: 10)

MERRLRALEQLARGEAGGCPGLDGLLDLLLALHHELSSGPLRRERSVAQFLSWASPFVSKVKELRLQRDDFEILK
VIGRGAFGEVTVVRQRDTGQIFAMKMLHKWEMLKRAETACFREERDVLVKGDSRWVTTLHYAFQDEEYLYLVMDY
YAGGDLLTLLSRFEDRLPPELAQFYLAEMVLAIHSLHQLGYVHRDVKPDNVLLDVNGHIRLADFGSCLRLNTNGM
VDSSVAVGTPDYISPEILQAMEEGKGHYGPQCDWWSLGVCAYELLFGETPFYAESLVETYGKIMNHEDHLQFPPD
VPDVPASAQDLIRQLLCRQEERLGRGGLDDFRNHPFFEGVDWERLASSTAPYIPELRGPMDTSNFDVDDDTLNHP
GTLPPPSHGAFSGHHLPFVGFTYTSAWAALERKLQCLEQEKLPAGGSPQLRKEVAALREQLEQAHSHRRLQEAEK
QSQALQQELAMLREELEQESKQRLEGERRETESNWEAQLADILSWVNDEKVSRGYLQALATKMAEELESLRNVGT
QDHQWKARRLQKMEASARLELQSALEAEIRAKQGLQERLTQVQEAQLQAEGCPPPQPGSHTLRPRSFPSPTKCLR
CTSLMLGLGRQGLGCDCGYFCHTTCAPQAPPCPVPPDLLRTALGVHPETGTGTAYEGFLSGVRRGWQRVFAALSD
SRLLLFDAPDLRLSPPSGALLQVLDLRDPQFSATPVLASDVIHAQSRDLPRIFRVSAWSQLAVPPTTCTVLLLAE
SEGERERWLQVLGELQRLLLDARPRPRPVYTLKEAYDNGLPLLPHTLCAAILDQDRLALGTEEGLFVIHLDIFQV
GECRRVQQLTLSPSAGLLVVLCGRGPSVRLFALAELENIEVAGAKIPESRGCQVLAAGSILQARTPVLCVAVKRQ
VLCYQLGPGPGPWQRRIRELQAPATVQSLGLLGDRLCVGAAGGFALYPLLNEAAPLALGAGLVPEELPPSRGGLG
EALGAVELSLSEFLLLFTTAGIYVDGAGRKSRGHELLWPAAPPGVPAGYAAPYLTVFSENSIDVFDVRRAEWVQT
VPLKKVRVRQSPGLPQVRPLNPEGSLFLYGTEKVRLTYLRNQLAGEGDEFDIPDLTDNSRRQLFRTKSKRRFFFR
VSEEQQKQQRREMLKDPFVRSKLISPPTNFNHLVHVGPANGRPGARDKSPVSPAPEFGNPSFLSFVSRVWDTKLR
PQPMSILSPALFLTKLAPDQSRTSLTPLHSSLADSKSLSPSSTPHEP

NOV4 Clones

Unless specifically addressed as NOV4a or NOV4b, any reference to NOV4 is assumed to encompass all variants.

A search against the Patp database, a proprietary database that contains sequences published in patents and patent publication, yielded several homologous proteins shown in Table 4E.

TABLE 4E

PatP Results for NOV4

| Sequences Producing High-Scoring Segment Pairs: | High Score | Smallest Sum Prob P (N) |
|---|---|---|
| patp: AAB42069 Human ORFX ORF1833 polypeptide sequence | 1516 | 1.4e−189 |
| patp: AAU17106 Novel signal transduction pathway protein - human | 1471 | 1.6e−150 |
| patp: AAR56979 Human myotonic dystrophy gene protein | 1326 | 8.5e−138 |
| patp: AAR38860 Myotonic dystrophy protein - Human | 1314 | 2.6e−136 |

TABLE 4E-continued

PatP Results for NOV4

| Sequences Producing High-Scoring Segment Pairs: | High Score | Smallest Sum Prob P (N) |
|---|---|---|
| patp: AAR41000 Human brain cDNA clone C28 protein kinase | 1215 | 2.2e−123 |

In a BLAST search of public sequence databases, it was found, for example, that the NOV4a nucleic acid sequence of this invention has 865 of 865 bases (100%) identical to a gb:GENBANK-ID:HSMDPKIN|acc:Y12337.1 mRNA from *H. sapiens* mRNA for myotonic dystrophy protein kinase like protein. Further, the fall amino acid sequence of the disclosed NOV4a protein of the invention has 314 of 572 amino acid residues (54%) identical to, and 418 of 572 amino acid residues (73%) similar to, the 1732 amino acid residue ptnr:SPTREMBL-ACC:O54874 protein from *Rattus norvegicus* (Rat) (MYTONIC DYSTROPHY KINASE-RELATED CDC42-BINDING KINASE).

Additional BLAST results are shown in Table 4F.

TABLE 4F

NOV4 BLASTP Results

| Gene Index/ Identifier | Protein/Organism | Length of aa | Identity (%) | Positives (%) | Expect Value |
|---|---|---|---|---|---|
| Q9W1B0 | GEK PROTEIN (LD24220P) - *Drosophila melanogaster* (fruit fly) | 1637 | 286/553 (51%) | 383/553 (69%) | 8.0e−225 |
| O44368 | GENGHIS KHAN - *Drosophila melanogaster* (fruit fly) | 1613 | 286/553 (51%) | 383/553 (69%) | 1.0e−224 |
| O01583 | HYPOTHETICAL 180.5 KDA PROTEIN - *Caenorhabditis elegans* | 1590 | 291/572 (50%) | 375/572 (65%) | 5.0e−207 |
| O54874 | MYTONIC DYSTROPHY KINASE-RELATED CDC42-BINDING KINASE - *Rattus norvegicus* (Rat) | 1732 | 314/572 (54%) | 418/572 (73%) | 1.2e−201 |
| O54875 | MYOTONIC DYSTROPHY KINASE-RELATED CDC42-BINDING KINASE MRCK-BETA - *Rattus norvegicus* (Rat) | 1702 | 307/570 (53%) | 405/570 (71%) | 3.7e−193 |

A multiple sequence alignment is given in Table 4G, with the NOV4 proteins of the invention being shown in lines 1 and 2 in a ClustalW analysis comparing NOV4 with related protein sequences of Table 4F.

Table 4G. ClustalW Analysis of NOV4

1. SEQ ID NO.: 8    NOV4a
2. SEQ ID NO.: 10    NOV4b
3. SEQ ID NO.: 144    Q9W1B0
4. SEQ ID NO.: 145    O44368
5. SEQ ID NO.: 146    O01583
6. SEQ ID NO.: 147    O54874
7. SEQ ID NO.: 148    O54875

```
                    10        20        30        40        50        60
              ....|....|....|....|....|....|....|....|....|....|....|....|
NOV4a         --------------MERRLRAL--------------EQLARGEAGG----CPGLDGLLDLLA   31
NOV4b         --------------MERRLRAL--------------EQLARGEAGG----CPGLDGLLDLLA   31
Q9W1B0        MEYESSEISDITTGSCKKRLTFLKCILSDTTSDQKWAAEFGEDTEGHQFSLDYLLDTFLV    60
O44368        ---------MYSKRHHKRS---------------KWAAEFDEDTEGHQFSLDYLLDTFLV    36
O01583        ---MAEPPPDDSAPVRLKTL------------ENIYMDGPSK-KPEALSFETLLDSLLC    43
O54874        ---------MSGEVRLRQL-------------EQFILDGPAQTNGQCFSVETLLDILLC    37
O54875        ---------MSAKVRLKKL-------------EQLLLDGPWR-NESSLSVETLLDVLVC    36

70        80        90       100       110       120
              ....|....|....|....|....|....|....|....|....|....|....|....|
NOV4a         LHHELSSGPLRRERSVACFLSWASPFVSKVKELRLQRDDFEILKVIGRGAFGEVTVVRQR   91
NOV4b         LHHELSSGPLRRERSVACFLSWASPFVSKVKELRLQRDDFEILKVIGRGAFGEVTVVRQR   91
Q9W1B0        LYDECSNSSLRREKGVSDFLKLSKPFVHIVRKLRLSRDDFDILKIIGRGAFGEVCVVQMI  120
O44368        LYDECSNSSLRREKGVSDFLKLSKPFVHIVRKLRLSRDDFDILKIIGRGAFGEVCVVQMI   96
O01583        LYDECCNSTLRKEKCIAEFVESVKTVISKAKKLRLSRDDFEVLKVICKGAFGEVAVVRMR  103
O54874        LYDECNNSPLRREKNILEYLEWAKPFTSKVKQMRLHREDFEILKVIGRGAFGEVAVVKLK   97
O54875        LYTECSHSALRRDKYVAEFLEWAKPFTQLVKDMQLHREDFEIKKVTGRGAFGEVAVVKMK   96

130       140       150       160       170       180
              ....|....|....|....|....|....|....|....|....|....|....|....|
NOV4a         DTGQLFAMKMLHKWEMLKRAETACFREERDVLVKGDSPWVTTLHYAFQDEEYLYLVMDYY  151
NOV4b         DTGQLFAMKMLHKWEMLKRAETACFREERDVLVKGDSPWVTTLHYAFQDEEYLYLVMDYY  151
Q9W1B0        STEKVYAMKILNKWEMLKRAETACFREERDVLVFGDRQWITNLHYAFQDNINLYLVMDYY  180
O44368        STEKVYAMKILNKWEMLKRAETACFREERDVLVFGDRQWITNLHYAFQDNINLYLVMDYY  156
O01583        GVGEIYAMKILNKWEMIKRAETACFREERDVLVYGDRRWITNLHYAFQDEKNLYFVMDYY  163
O54874        NADKVFAMKILNKWEMLKRAETACFREERDVLVNGDSKWITTLHYAFQDDNNLYLVMDYY  157
O54875        NTERIYAMKILNKWEMLKRAETACFREERDVLVNGDCCWITALHYAFQDENYLYLVMDYY  156

190       200       210       220       230       240
              ....|....|....|....|....|....|....|....|....|....|....|....|
NOV4a         AGGDLLTLLSRFEDRLPPELAQFYLAEMVLAIHSLHQLGYVHRDVKPDNVLLDVNGHIRL  211
NOV4b         AGGDLLTLLSRFEDRLPPELAQFYLAEMVLAIHSLHQLGYVHRDVKPDNVLLDVNGHIRL  211
Q9W1B0        CGGDLLTLLSKFEDRLPEDMAKFYTTEMLLAINSIHQIRYVHRDIKPDNVLLDKRGHVRL  240
O44368        CGGDLLTLLSKFEDRLPEDMAKFYTTEMLLAINSIHQIRYVHRDIKPDNVLLDKRGHVRL  216
O01583        IGGDMLTLLSKFVDHIPESMAKFYLAEMVLAIDSLHRLGYVHRDVKPDNVLLDMQGHIRL  223
O54874        VGGDLLTLLSKFEDRLPEEMARFYLAEMVIAIDSVHQLHYVHRDIKPDNILMDMNGHIRL  217
O54875        VGGDLLTLLSKFEDKLPEDMARFYIGEMVLAIDSTHQLHYVHRDIKPDNVLLDVNGHIRL  216
```

```
                    65                              66
            250       260       270       280       290       300
            ....|....|....|....|....|....|....|....|....|....|....|
NOV4a    ADFGSCLRLNTNGMVDSSVAVGTPDYISPEILQAMEEGKGHYGPQCDWWSLGVCAYELLF  271
NOV4b    ADFGSCLRLNTNGMVDSSVAVGTPDYISPEILQAMEEGKGHYGPQCDWWSLGVCAYELLF  271
Q9W1B0   ADFGSCLRLDKDGTVQSNVAVGTPDYISPEILRAMEDGKGRYGTECDWWSLGVCMYEMLY  300
O44368   ADFGSCLRLDKDGTVQSNVAVGTPDYISPEILRAMEDGKGRYGTECDWWSLGVCMYEMLY  276
O01583   ADFGSCLRLLADGSVASNVAVGTPDYISPEILRAMEDGRGRYGKECDWWSLGVCMYEMLY  283
O54874   ADFGSCLKLMEDGTVQSSVAVGTPDYISPEILQAMEDGKGRYGPECDWWSLGVCMYEMLY  277
O54875   ADFGSCIKMNDGTIVQSSVAVGTPDYISPEILQAMEDGMGKYGPECDWWSLGVCMYEMLY  276

310       320       330       340       350       360
            ....|....|....|....|....|....|....|....|....|....|....|
NOV4a    GETPFYAESLVETYGKIMNHEDHLQFPPDVP---DVPASAQDLIRQLLCRQEERLGRGGL  328
NOV4b    GETPFYAESLVETYGKIMNHEDHLQFPPDVP---DVPASAQDLIRQLLCRQEERLGRGGL  328
Q9W1B0   GETPFYAESLVETYGKIMNHQNCFNLPSQETLNYKVSETSCDLLCKLICIPENRLGQNGL  360
O44368   GETPFYAESLVETYGKIMNHQNCFNLPSQETLNYKVSETSCDLLCKLICIPENRLGQNGL  336
O01583   GTTPFYSERLVDTYGKIMSHQDMLDFPDDEID-WVVSEEAKDLIRQLICSSDVRFGRNGL  342
O54874   GETPFYAESLVETYGKIMNHKERFQFPTQVT---DVSENAKDLIRRLICSREHRLGQNGL  334
O54875   GETPFYAESLVETYGKIMNHEERFQFPSHVT---DVSEEAKDLIQRLICSRERRLGQNGL  333

370       380       390       400       410       420
            ....|....|....|....|....|....|....|....|....|....|....|
NOV4a    DDFRNHPFFEGVDWERLASSTAPYIPELRGPMDTSNFDVD--DDTLNHPGILPPPSHGAF  386
NOV4b    DDFRNHPFFEGVDWERLASSTAPYIPELRGPMDTSNFDVD--DDTLNHPGILPPPSHGAF  386
Q9W1B0   QDFMDHPWFVGIDWKNIRQGPAPYVPEVSSPTDTSNFDVD--DNDVRLTDSIPPSANPAF  418
O44368   QDFMDHPWFVGIDWKNIRQGPAPYVPEVSSPTDTSNFDVD--DNDVRLTDSIPPSANPAF  394
O01583   SDFQLHPFFECIDWNTIRDSNPPYVVPEVSSPEDTSNFDVDVCEDDFTPCETQPPRVLAAF  402
O54874   EDFKKHPFFSGIDWDNIRNCEAPYIPEVSSPTDTSNFDVD--DDCLKNSETMPPPTHTAF  392
O54875   EDFKKHAFFEGLNWENIRNLEAPYIPDVSSPSDTSNFDVD--DDVLRNIEILPPGSHTGF  391

430       440       450       460       470       480
            ....|....|....|....|....|....|....|....|....|....|....|
NOV4a    SGHHLPFVGFTYTS-----------------------------AWAALERKLQCLE    413
NOV4b    SGHHLPFVGFTYTS-----------------------------AWAALERKLQCLE    413
Q9W1B0   SGFHLPFIGFTFSLTS---------------------------SS-TLDSKKNQSSGFG  449
O44368   SGFHLPFIGFTFSLTS---------------------------SS-TLDSKKNQSSGFG  425
O01583   IGNHLPFVGFSYTHGSLLSDARSLTDEIRAIAQRCQG------DAELMEKSVDGFMVELE  456
O54874   SGHHLPFVGFTYTSSCVLSDRSCLRVTAGPTSLDLDVNVQRTLDNNLATEAYERRIKRLE  452
O54875   SGLHLPFIGFTFTTESCFSDRGSLKSMIQSNTLTKDEDVQRDLENSLQIEAYERRIRRLE  451

490       500       510       520       530       540
            ....|....|....|....|....|....|....|....|....|....|....|
NOV4a    QEKLPAG---------GSPQ------------LRKEVAALR------------  433
NOV4b    QEKLPAG---------GSPQ------------LRKEVAALR------------  433
Q9W1B0   DDTLDTIS----SPQLAILPSNNSE----TPVDSVQLKALNDQLAALK------------  489
O44368   DDTLDTIS----SPQLAILPSNNSE----TPVDSVQLKALNDQLAALK------------  465
O01583   NEKAELVQKLKEAQTIIAQHVAENPRSEEDRNYESTIAQLKDETQILN------------  504
O54874   QEKLELTRKLQESTQTVQALQYSTVDGPLTASKDLETKSLKEEIEKLRKQVAEVNHLEQQ  512
O54875   QEKLELSRKLQESTQTVQSLHGSTR-ALGNSNRDKEIKRLNEELERMKSKMADSNRLERQ  510

550       560       570       580       590       600
            ....|....|....|....|....|....|....|....|....|....|....|
NOV4a    ------------------------------------------EQLEQAHSHR  443
NOV4b    ------------------------------------------EQLEQAHSHR  443
Q9W1B0   ---------------------QEKAELSKQHNEVFERLKTQDSELQDAISCR  520
O44368   ---------------------QEKAELSKQHNEVFERLKTQDSELQDAISCR  496
```

```
001583  ------------------------------------KRLEDEALAQQQKPKDEIVAESEK  529
O54874  LEEANSVRRELDDAFRQIKAFEKQIKTLQQEREELNKELVQASERLKNQSKELKDAHCQR  572
O54875  LEDTVTLRQEHEDSTQRLKGLEKQYRLARQEKEELHKQLVEASERLKSQTKELKDAHQQR  570

610       620       630       640       650       660
              ....|....|....|....|....|....|....|....|....|....|....|....|
NOV4a   R-----------------------------------------------------------  444
NOV4b   R-----------------------------------------------------------  444
Q9W1B0  NIAMMEYSEVTEKLSELRNQKQKLSRQVRDKEEELDGAMQKNDSLRNELRKSDKTRRELE  580
O44368  NIAMMEYSEVTEKLSELRNQKQKLSRQVRDKEEELDGAMQKNDSLRNELRKSDKTRRELE  556
001583  K-----LKELKERNKQLVMEKSEIQRELDNINDHLDQVLVEKATVVQ---QRDDMQAELA  581
O54874  KLAMQEFMEINERLTELHTQKQKLARHVRDKEEEVDLVMQKAESLRQELRRAERAKKELE  632
O54875  KRALQEFSELNERMAELRSQKQKVSRQLRDKEEEMEVAMQKIDSMRQDIRKSEKSRKELE  630

670       680       690       700       710       720
              ....|....|....|....|....|....|....|....|....|....|....|....|
NOV4a   ------------------------------------------------------------  444
NOV4b   ------------------------------------------------------------  444
Q9W1B0  LHIEDAVIEAAKEKKLREHAEDCCRQLQMELRK-----GS-SSVETTMPLSISSEMSSYE  634
O44368  LHIEDAVIEAAKEKKLREHAEDCCRQLQMELRK-----GS-SSVETTMPLSISSEMSSYE  610
001583  DVGDSLLTEKDSVKRLQDEAEKAKKQVADFEEK--------------LKEIETEKIALI  626
O54874  VHTEALIAEASKDRKLREQSRHYSKQLENELEGLKQKQISYSPGICSIEHQQEITKLKTD  692
O54875  ARLEDAVAEASKERKLREHSESFSKQMERELETLKVKQGGRGPG-ATLEHQQEISKIRSE  689

730       740       750       760       770       780
              ....|....|....|....|....|....|....|....|....|....|....|....|
NOV4a   ----------------------------LQEAEKQSQALQQELAMLREELEQ------  468
NOV4b   ----------------------------LQEAEKQSQALQQELAMLREELEQ------  468
Q9W1B0  IERLELQFSEKLSHQQTRHN-MELEALREQFSELENANLALTKELQQTQERLKYTQMESI  693
O44368  IERLELQFSEKLSHQQTRHN-MELEALREQFSELENANLALTKELQQTQERLKYTQMESI  669
001583  KKQEEVTIEARKSVETDDHLSEEVVAAKNTIASLQATNEERETEIKKLKQRMDEERASHT  686
O54874  LEKKSIFYEEEISKREGIHA-SEIKNLKKELHDSEGQQLAINKEIMVLKDKLEKTRRESQ  751
O54875  LEKKVLFYEEELVRRERSHV-LEVKNVKKEVHESESHQLALQKEVLMLKDKLEKSKRERH  748

790       800       810       820       830       840
              ....|....|....|....|....|....|....|....|....|....|....|....|
NOV4a   -------------------ESKQRLEGE--------------------------RR  479
NOV4b   -------------------ESKQRLEGE--------------------------RR  479
Q9W1B0  TDSAETLLELKKQHDLEKSSWFEEKQRLSSEVNLKSKSLKELQAED---DEIFKELRMKR  750
O44368  TDSAETLLELKKQHDLEKSSWFEEKQRLSSEVNLKSKSLKELQAED---DEIFKELRMKR  726
001583  AQSEQEMKQLEAHYERAQKMLQDNVEQMNVENRGLRDEIEKLS----------QQMAAL  735
O54874  SEREEFENEFKQQYEREKVLLTEENKKLTSELDKLTSLYESLSLRNQHLEEEVKDLADKK  811
O54875  SEMEEAIGAMKDKYERERAMLFDENKKLTAENEKLCSFVDKLTAQNRQLEDELQDLASKK  808

850       860       870       880       890       900
              ....|....|....|....|....|....|....|....|....|....|....|....|
NOV4a   ETESNWEAQLADILSWVNDEKVSRGYLQALATKMAEELESLRN---------VGTQDHQW  530
NOV4b   ETESNWEAQLADILSWVNDEKVSRGYLQALATKMAEELESLRN---------VGTQDHQW  530
Q9W1B0  EAITLWERQMAEIIQWVSDEKDARGYLQALAIKMTEELEYLKHVG--TFNNNGVDKNW  807
O44368  EAITLWERQMAEIIQWVSDEKDARGYLQALAIKMTEELEYLKHVG--TFNNNGVDKNW  783
001583  PRGGLNEQQLHEIFNWVSEEKATREEMENLTRKITGEVESLKNNSPLTTSNYIQNTPSGW  795
O54874  ESVAHWEAQITEIIQWVSDEKDARGYLQALASKMTEELEALRNS-----SLGTRATDMPW  866
O54875  ESVAHWEAQIAEIIQWVSDEKDARGYLQALASKMTEELETLRSS-----SLGSRTLDPLW  863

910       920       930       940       950       960
              ....|....|....|....|....|....|....|....|....|....|....|....|
NOV4a   KARRLQKMEASARLELQSALEAEIRAKQGLQERLTQVQEAQLQAEG------------  576
```

```
NOV4b    KARRLQKMEASARLELQSALEAEIRAKQGLQFRLTQVQEAQLQAEG--------------- 576
Q9W1B0   RNRRSQKLDKMELLNLQSALQREIQAKNMISDELSQTRSDLISTQKEVRDYKKRYDSILH 867
O44368   RNRRSQKLDKMELLNLQSALQREIQAKNMISDELSQTRSDLISTQKEVRDYKKRYDSILH 843
O01583   GSRRMNNVARKDGLDLQRQLQAEIDAKLKLKAELKNSQEQYLTSAARLDDTEKRMASLMR 855
O54874   KMRRFAKLDMSARLELQSALDAEIRAKQAIQEELNKVKASNIITECKLKDSEKKNLELLS 926
O54875   KVRRSQKLDMSARLELQSALEAEIRAKQLVHEELRKVKDTSLAFESKLKESEAKNRELLE 923

970       980       990      1000      1010      1020
         ....|....|....|....|....|....|....|....|....|....|....|....|
NOV4a    ------------------------------------------------------------ 576
NOV4b    ------------------------------------------------------------ 576
Q9W1B0   DFQKKETELRDLQKGGLEYSESFLNKSTHHG-LSSAFFRDMSKNSEIIDSAESFGNESGD 926
O44368   DFQKKETELRDFEKGGLEYSESFLNKSTHHG-LSSAFFRDMSKNSEIIDSAESFGNESGD 902
O01583   EVAMLKQQKNIENS-----SDSAFSSTMGRGDLMISMNNDYEMSNSSLMRQEMISRQSTP 910
O54874   EIEQLIKDTEE-LR-----SEKGVEHRDSQH-SFLAFLNTPTDALDQFERSPSCTP-AGK 978
O54875   EMQSLKKRMEEKFR-----ADTGLKLPDFQD-PIFEYFNTAPLAHDLTFRTSSASDQETQ 977

1030      1040      1050      1060      1070      1080
         ....|....|....|....|....|....|....|....|....|....|....|....|
NOV4a    ------------------------------------------------CP-----P-- 579
NOV4b    ------------------------------------------------CP-----P-- 579
Q9W1B0   NFTPNFFQSGNSGMLFNYEPKYAGKNNKDHSSMKEASVSDLSREESDQLVKESQKKVP-- 984
O44368   NFTPNFFQSGNSGMLFNYEPKYAGKNNKDHSSMKEASVSDLSREESDQLVKESQKKVP-- 960
O01583   ----------------------SYENAILLHDHQVPKRVDDLRYKQKPMKTASGIFSP-- 946
O54874   ----------------------GRRIADSAPLPVHTPT------LRKKGCPASAGFP-- 1007
O54875   ----------------------ASKLDLSPSVSVATSTEQQEDAARSQQRPSTVPLPNT 1014

1090      1100      1110      1120      1130      1140
         ....|....|....|....|....|....|....|....|....|....|....|....|
NOV4a    -------PQPGSHTLRPRSFPSPTKCLRCTSLMLGLRQGLGCD-CGYFCHTTCAPQAPP 631
NOV4b    -------PQPGSHTLRPRSFPSPTKCLRCTSLMLGLRQGLGCD-CGYFCHTTCAPQAPP 631
Q9W1B0   -------GNTAIHQFLVRTFSSPTKCNHCTSLMVGLTRQGVVCEICGFACHTICCQKVPT 1037
O44368   -------GNTAIHQFLVRTFSSPTKCNHCTSLMVGLTRQGVVCEICGFACHTICCQKVPT 1013
O01583   ---VSISAMERGHNFERMKIKTPTKCGHCTSILIGLDRQGLFCQSCQYACHVSCAERVSQ 1003
O54874   -------PKRKTHQFFVKSFTAPTKCHQCTSLMVGLIRQGCSCEVCGFSCHITCVNKAPT 1060
O54875   QALAMAGPKPKAHQFSIKSFPSPTQCSHCTSLMVGLIRQGYACEVCAFSCHVSCKDSAPQ 1074

1150      1160      1170      1180      1190      1200
         ....|....|....|....|....|....|....|....|....|....|....|....|
NOV4a    -CPVPPDLLRTALGVHPETGTGTAYEGFL-----SGVRRGWQRVFAALSDSRLLLEDAPD 685
NOV4b    -CPVPPDLLRTALGVHPETGTGTAYEGFL-----SGVRRGWQRVFAALSDSRLLLEDAPD 685
Q9W1B0   TCPVPMDQTKRPLGIDPTRGTGTAYEGYVKVPKSGVIKRGWIRQFVVVCDFKLFLYDISP 1097
O44368   TCPVPMDQTKRPLGIDPTRGTGTAYEGYVKVPKSGVIKRGWIRQFVVVCDFKLFLYDISP 1073
O01583   SCPVP-EEERRPLGIDPTRGVGTAYEGLVKTPRAGGVRKGWQTAYVVVCDFKLYLYDCTV 1062
O54874   TCPVPPEQTKGPLGIDPQKGVGTAYEGHVRIPKPAGVKKGWQRALAVVCDFKLFLYDIAE 1120
O54875   VCPIPPEQSKRPLGVDVQRGTGTAYKGYVKVPKPTGVKKGWQRAYAVVCDCKLFLYDLPE 1134

1210      1220      1230      1240      1250      1260
         ....|....|....|....|....|....|....|....|....|....|....|....|
NOV4a    LR---LSPPSGALLQVLDLRDPQFSATPVLASDVIHAQSRDLPRIFRVTT-SQLAVPPTT 741
NOV4b    LR---LSPPSGALLQVLDLRDPQFSATPVLASDVIHAQSRDLPRIFRVSAWSQLAVPPTT 742
Q9W1B0   DR---CALPSVSVSQVLDMRDPEFSVGSVRESDVIHAAKKDVPCIFKIKT--ALIDGGLS 1152
O44368   DR---CALPSVSVSQVLDMRDPEFSVGSVRESDVIHAAKKDVPCIFKIKT--ALIDGGLS 1128
O01583   DRQNKMQDVKNEIRLVLDMRDPEFTVCGVSEADVIHAQKGDIPKIFRVITTQILNSSSEY 1122
O54874   GK---ASQPSSVISQVLDMRDEEFSVSSVLASDVIHASRKDIPCIFRVIA-SQLSAPSDK 1176
O54875   GK---STQPGVIASQVLDLRDDEFAVSSVLASDVIHATRRDIPCIFRVIA-SLLGSPSKT 1190
```

71                                                                72

```
              1270       1280       1290       1300       1310       1320
              ....|....|....|....|....|....|....|....|....|....|....|....|
NOV4a    CT-----VLLLAESEGERERWLQVLGELQRILLDARPRPRPVYTLKEAYDN-GLPLLPHT   795
NOV4b    CT-----VLLLAESEGERERWLQVLGELQRILLDARPRPRPVYTLKEAYDN-GLPLLPHT   796
Q9W1B0   LN-----TLMLADNESEKSKWVIALGELHRILKRNSLPNTAIFKVNEILDN-TLSLIRNA  1206
O44368   LN-----TLMLADNESEKSKWVIALGELHRILKRNSLPNTAIFKVNEILDN-TLSLIRNA  1182
O01583   SSSSKFYTLFMAETEEEKRKWVVALSELKTLLRRSKLADRKAFLVKEVFDVTLPSIRVA  1182
O54874   CS-----IMMLADSETERSKRKWVGVLSELHKVLKKNKFRDRSVYVPKEAYDS-TLPLIKTT  1230
O54875   SS-----LLLLTENENENEKRKWVGILEGLQAILHKNRLRSQVVHVAQEAYDS-SLPLIKTV  1244

1330       1340       1350       1360       1370       1380
              ....|....|....|....|....|....|....|....|....|....|....|....|
NOV4a    LCAAILDQDRLALGT-EEGLFVIHLD---IFQVGECRR-----VQQLTLSPSAGLLVVLC   846
NOV4b    LCAAILDQDRLALGT-EEGLFVIHLD---IFQVGECRR-----VQQLTLSPSAGLLVVLC   847
Q9W1B0   LCSVITYPNQILLGT-EDGLFYINLDQYEIARIGESKK-----ILQLWYIEEEQILVLLC  1260
O44368   LCSVITYPNQILLGT-EDGLFYINLDQYEIARIGESKK-----ILQLWYIEEEQILVLLC  1236
O01583   QCCAIIDRSKIVIGFSDHGLYCIEISRQLLIPVGGEKENKQRCVETVEYDEAEQLLMMIV  1242
O54874   QAAAIIDHERVALGN-EEGLFVVHVTKDEIIRVGDNKK-----IHQIELIPSDLVAVIS   1284
O54875   LAAAIIDGDRLAVGL-EEGLYVIELTRDVIVRAADCKK-----VYQIELAPKEKLILLLC  1298

1390       1400       1410       1420       1430       1440
              ....|....|....|....|....|....|....|....|....|....|....|....|
NOV4a    G--RGPSVRLFALAELENIEVAGA--KIPESRGCQVLAAGSIL--QARTPVLCVAMKR--   898
NOV4b    G--RGPSVRLFALAELENIEVAGA--KIPESRGCQVLAAGSIL--QARTPVLCVAMKR--   899
Q9W1B0   G--KQRNLRLLPTRALEASDVEWI--KVVESKNCISACTGIIRRFPNIVYSFIIALKRPN  1316
O44368   G--KQRNLRLLPTRALEASDVEWI--KVVESKNCISACTGIIRGFPNIVYSFIIALKRPN  1292
O01583   GPAKDRHVRIVPSAALDGRDLKWI--KVNDTKGCHLLAVGTNNP-GGRAGFFAVAEFKK--  1297
O54874   G--RNRHVRLFPMSALDGRETDFY--KLAETKGCQTIAAGKVR--HGALSCLCVAMKR--  1336
O54875   G--RNHHVHLYPWTSFDGAEASNFDIKPETKGCQLIATGTLR--KSSSTCLFVAMKR--  1352

1450       1460       1470       1480       1490       1500
              ....|....|....|....|....|....|....|....|....|....|....|....|
NOV4a    ---QVLCYQLGPGPGPWQRRIRELQAPATVQSIGLLGDR-LCVGAAGGFALYPLLNEAAP   954
NOV4b    ---QVLCYQLGPGPGPWQRRIRELQAPATVQSIGLLGDR-LCVGAAGGFALYPLLNEAAP   955
Q9W1B0   NHTQLVVYEINR-TRTRHQKTCEFTIGYMACHLQILSDMRLVVAHQSGFTAYFLRGEATA  1375
O44368   NHTQLVVYEINR-TRTRHQKTCEFTIGYMACHLQILSDMRLVVAHQSGFTAYFLRGEATA  1351
O01583   ---SVTIFQIDR-SEKRHKKWKDLAMPGTPQSIAIFNGR-LYVGFSHSFRSWSLVGVDSS  1352
O54874   ---QVLCYELFQ-SKTRHRKFKEIQVPCNVQWMAIFSEH-LCVGFQSGFLRYPINGEGSP  1391
O54875   ---LVLCYEIQR-IKPFHRKFNEIVAPGHVQWMAMFKDR-LCVGYPSGFSLLSIQCDGQP  1407

1510       1520       1530       1540       1550       1560
              ....|....|....|....|....|....|....|....|....|....|....|....|
NOV4a    ---------------LALGAGLVPEELPPSRGGLGEALGAVELSLS------ERLLLFTTA   994
NOV4b    ---------------LALGAGLVPEELPPSRGGLGEALGAVELSLS------ERLLLFTTA   995
Q9W1B0   ---------------MSLVHPENQLCAFLNYSGV-DAVRVLEILCPSGGNFGEYLLVFQTL  1420
O44368   ---------------MSLVHPENQLCAFLNYSGV-DAVRVLEILCPSGGNFGEYLLVFQTL  1396
O01583   PVGSGDASGAVLQHISLVNMEDTSLQFLNQQTSYEAKLIVNVPGSPD----EYLLVENMI  1408
O54874   ---------------CNMLHSNDHTLAFITHQPM-DAICAVELSNK------EYLLCFSSI  1430
O54875   ---------------LDLVNPADPSLAFLSQQSF-DALCAVELKSE------EYLLCFSHM  1446

1570       1580       1590       1600       1610       1620
              ....|....|....|....|....|....|....|....|....|....|....|....|
NOV4a    GIYVDGAGRKS--------------------LFSENSIDVFDVRRAEWVQTVPLKK  1030
NOV4b    GIYVDGAGRKSRGHELLWPAAPPGVPAGYAAPYLTVFSENSIDVFDVRRAEWVQTVPLKK  1055
Q9W1B0   AIYVDLQGRKSRDREIMYPAFP--TYITFCDGHLLVFSDTHLDIFNTQTAEWVQSIGLKQ  1478
O44368   AIYVDLQGRKSRDREIMYPAFP--TYITFCDGHLLVFSDTHLDIFNTQTAEWVQSIGLKQ  1454
O01583   GLYVNEMGRPSRLPEVMFPTQA--KYFAVHEPYLCVFSENEVDIFNVTLAEWVQTINLRS  1466
```

```
O54874   GIYTDCQGRRSRQQELMWPANP--SSCCYNAPYLSIYSENAVDIFDVNSMEWIQTLPLKK  1488
O54875   GLYVDPQGRPSRTQELMWPAAP--VACSCSSSHVTVYSEYGVDVFDVRTMEWVQTIGLRR  1504

1630      1640      1650      1660      1670      1680
              ....|....|....|....|....|....|....|....|....|....|....|....|
NOV4a    VR----------PLNPEGSLFLYGTEK-------------DEFDIPDLTDNSRRQLFR  1065
NOV4b    VRVRQSPGLPQVRPLNPEGSLFLYGTEKVRLTYLRNQLAGEGDEFDIPDLTDNSRRQLFR  1115
Q9W1B0   SL----------PLNNLGNVVLSSVNDTPLIVYLSN----IHTKGLLQYRDGNRKGLPS  1523
O44368   SL----------PLNNLGNVVLSSVNDTPLIVYLSN----IHTKGLLQYRDGNRKGLPS  1499
O01583   AK----------PLSGDGILSTCLCNDSPIFVLLQNVLQDQDSIEVPVNLASGSTDGRK  1515
O54874   VR----------PLNTEGSLNLLGLETIRLIYFKNKMAE-GDELVVPETSDNSRKQMVR  1536
O54875   IR----------PLNSDGSLNLLGCEPPCLIYFKNKFS--GTVLNVPDTSDNSKKQMLR  1551

1690      1700      1710      1720      1730      1740
              ....|....|....|....|....|....|....|....|....|....|....|....|
NOV4a    -TKSKRRFFFRVSEEQQKQQRREMLKDPFVRSKLISPPTNFNHLVHVGPANG--------  1116
NOV4b    -TKSKRRFFFRVSEEQQKQQRREMLKDPFVRSKLISPPTNFNHLVHVGPANG--------  1166
Q9W1B0   ---IKRRFSIREINKTIKSDR---------RSKMISAPTNFNHLSHMGPGDGIQ------  1565
O44368   ---IKRRFSIREINKTIKSDR---------RSKMISAPTNFNHLSHMGPGDGIQ------  1541
O01583   --VTRRKFTFRTIGKDDRSASERR------SHIQISTPSDFMHIVHMGPAP---------  1558
O54874   NINNKRRYSFRVPEEERMQQRREMLRDPEMRNKLISNPTNFNHIAHMGPGDGIQILKDLP  1596
O54875   -TRSKRRFVFKVPEEERLQQRREMLRDPELRSKMISNPTNFNHVAHMGPGDGMQVLMDLP  1610

1750      1760      1770      1780      1790      1800
              ....|....|....|....|....|....|....|....|....|....|....|....|
NOV4a    ---RPGARD-------------KSPVSPAPEFGNP-----------SFLSFVSRVWDTK  1148
NOV4b    ---RPGARD-------------KSPVSPAPEFGNP-----------SFLSFVSRVWDTK  1198
Q9W1B0   ----------------------NQRLLDLPTTLET-----------ADQACSPIIHS   1589
O44368   ----------------------NQRLLDLPTTLET-----------ADQACSPIIHS   1565
O01583   ---------------------------------------------------------   1558
O54874   MNPRPQESRTVFSGSVSIPSITKSRPEPGRSMSASSGLSARSSAQNGSALKREFSGGSYN  1656
O54875   LSVRPQPRR-------------KSRVLPQQASLGS--LPSR----NKPYVSWPSSGGSEP  1651

1810      1820      1830      1840      1850      1860
              ....|....|....|....|....|....|....|....|....|....|....|....|
NOV4a    LRPQPMSILS-----------PAL----FLTKLAPDQSRTSLTPLHSSLADSKSLSPSS  1192
NOV4b    LRPQPMSILS-----------PAL----FLTKLAPDQSRTSLTPLHSSLADSKSLSPSS  1242
Q9W1B0   LSCIPQSRKS-----------N------FLEQVDANSDDYGNDNIISRTPSPMASSFMD  1631
O44368   LSCIPQSRKS-----------N------FLEQVDANSDDYGNDNIISRTPSPMASSFMD  1607
O01583   ----------------------------VMELQQNFIDLQSNHSHTSSDKDSLNRS    1586
O54874   TKRQPMPSPSEGSLSSGGVDQGSDAPVRDYDGE-DSDSPRHSTASNSSNLSSPPSPVSPR  1715
O54875   GVPVPLRSMS---------D--PDQ---DFDKEPDSDSTKHSLRPTAPTLAAPRAPTHRT  1697

1870
              ....|....|....|..
NOV4a    TPHEP------------  1197
NOV4b    TPHEP------------  1247
Q9W1B0   GLSNND-----------  1637
O44368   GLSNND-----------  1613
O01583   VNND-------------  1590
O54874   KTKSLSLESTDRGSWDP  1732
O54875   GASSL------------  1702
```

The presence of identifiable domains in the disclosed NOV4 protein was determined by using Pfam and then determining the Interpro number. The results are listed in Table 4H with the statistics and domain description.

TABLE 4H

Domain Analysis of NOV4

| PSSMs Producing Significant Alignments | Score (bits) | E Value |
| --- | --- | --- |
| pkinase: domain 1 of 1, from 71 to 337 | 231.5 | 1.3e-65 |

```
PKinase      yelleklGeGsfGkVykakhk.tgkivAvKilkkesls........1
             +++++++|+|++|+|  ++ +++++++|+|+++++++ ++ ++   +
NOV4         FEILKVIGRGAFGEVTVVRQRdTGQIFAMKMLHKWEMLkraetacfR PKinase      rEiqilkrlsHpNIvrllgvfedtddhlylvmEymegGdLfdylrrng.p
             |  ++ + +  + +++++++ ++++++++++++  +|+|++++++  ++
NOV4         EERDVLVKGDSRWVTTLHYAFQ-DEEYLYLVMDYYAGGDLLTLLSRFEdR PKinase      lsekeakkialQilrGleYLHsngivHRDLKpeNILldengtvKiaDFGL
             ++++ ++++  +++ ++   ||  + +|||+|++|+|++ +++++++|||
NOV4         LPPELAQFYLAEMVLAIHSLHQLGYVHRDVKPDNVLLDVNGHIRLADFGS PKinase      Arll.....eklttfvGTpwYmmAPEvileg.....rgysskvDvWSlGv
             +  +++++ +  +  +||++|+ +||+ ++  ++++ ++++++|+||+|+
NOV4         CLRLntngmVDSSVAVGTPDYI-SPEI-LQAmeegkGHYGPQCDWWSLGV PKinase      iLyElltggplfpgadlpaftggdevdqliifvlklPfsdelpkttridpl
              +|++++                              ++|++        ++
NOV4         CAYELLFG------------------------ETPFYA-------ESLV PKinase      eelfrikkr..rlplpsncSee...lkdLlkkcLnkDPskRpGsatakei
             + + ++ ++++++ +++ +++ + ++++|++++|++  ++|+|++   ++
NOV4         ETYGKIMNHedHLQFPPDVPDVpasAQDLIRQLLCRQ-EERLGRGGLDDF PKinase      lnhpwf      (SEQ ID NO:149)
             +++++
NOV4         RNHPFF      (SEQ ID NO:8)
```

Consistent with other known members of the myotonic dystrophy kinase-related Cdc42-binding kinases (MRCKs) family of proteins, NOV4 contains protein kinase domains as illustrated in Table 4H.

NOV4 nucleic acids, and the encoded polypeptides, according to the invention are useful in a variety of applications and contexts. For example, NOV4 nucleic acids and polypeptides can be used to identify proteins that are members of the protein kinase family of proteins. The NOV4 nucleic acids and polypeptides can also be used to screen for molecules, which inhibit or enhance NOV4 activity or function. Specifically, the nucleic acids and polypeptides according to the invention may be used as targets for the identification of small molecules that modulate or inhibit, e.g., cytoskeletal reorganization or molecular switch mechanisms. These molecules can be used to treat, e.g., myotonic dystrophy, myotonic dystrophy type 2, proximal myotonic myopathy, or proximal myotonic dystrophy.

In addition, various NOV4 nucleic acids and polypeptides according to the invention are useful, inter alia, as novel members of the protein families according to the presence of domains and sequence relatedness to previously described proteins. For example, the NOV4 nucleic acids and their encoded polypeptides include structural motifs that are characteristic of proteins belonging to the family of protein kinases such as the MRCK protein. MRCK is a Ser/Thr kinase that is highly related to myotonic dystrophy kinase and ROKs. MRCK contains an N-terminal kinase domain, a coiled-coil region, a cysteine-rich domain (CR), a pleckstrin-like domain (PH), and a C-terminal p21 GTPase-binding domain (GBD). Two different MRCK genes are expressed in rat. MRCKa mRNA is enriched in brain and lung, while MRCKb mRNA is expressed in lung and kidney. MRCKa phosphorylates Ser/Thr residues in myelin basic protein, histone H1, and non-muscle myosin regulatory light chain. In HeLa cells, expression of kinase-dead MRCKa blocks Cdc42-dependent formation of focal complexes and peripheral microspikes, while in PC12 cells MRCKa may act downstream of Cdc42 and Rac1 to promote neurite outgrowth.

The NOV4 nucleic acids and polypeptides, antibodies and related compounds according to the invention will be useful in therapeutic and diagnostic applications in the mediation of cell migration and differentiation. As such the NOV4 nucleic acids and polypeptides, antibodies and related compounds according to the invention may be used to treat muscle, or cell migration disorders, e.g., myotonic dystrophy, myotonic dystrophy type 2, proximal myotonic myopathy, proximal myotonic dystrophy, neuromuscular diseases associated with cardiomyopathy, multiple endocrine neoplasia type 1(MEN1), insulin dependent diabetes mellitus, familial paraganglioma type 2, spinocerebellar ataxia type 5, Bardet-Biedl syndrome, non-hodgkins lymphoma, cancers such as breast cancer, liver, lung, pancrease, and prostate cancers.

The NOV4 nucleic acids and polypeptides are useful for detecting specific cell types. For example, expression analysis has demonstrated that a NOV4 nucleic acid is expressed in adrenal gland, bone marrow, brain—amygdala, brain—cerebellum, brain—hippocampus, brain—substantia nigra, brain—thalamus, brain—whole, fetal brain, fetal kidney, fetal liver, fetal lung, heart, kidney, lymphoma—Raji, mammary gland, pancreas, pituitary gland, placenta, prostate, salivary gland, skeletal muscle, small intestine, spinal cord, spleen, stomach, testis, thyroid, trachea, and uterus.

Additional utilities for NOV4 nucleic acids and polypeptides according to the invention are disclosed herein.

NOV5

The disclosed NOV5 nucleic acid (alternatively referred to herein as CG56288-01) encodes a novel S100 calcium binding-like protein and includes the 332 nucleotide sequence (SEQ ID NO:11) shown in Table 5A. Although SignalP, Psort and/or hydropathy suggest that the S100 Calcium Binding Protein-like protein may be localized in the cytoplasm, the protein predicted here is similar to the S100 Calcium Binding Protein family, some members of which are secreted. Therefore it is likely that this novel S100 Calcium Binding Protein-like protein is available at the same sub-cellular localization and hence accessible to a diagnostic probe and for various therapeutic applications.

An open reading frame for the mature protein was identified beginning with an ATG initiation codon at nucleotides 8–10, and ending with a TGA stop codon at nucleotides 320–322. Putative untranslated regions, if any, are found upstream from the initiation codon and downstream from the termination codon. The start and stop codons are in bold letters.

A search against the Patp database, a proprietary database that contains sequences published in patents and patent publication, yielded several homologous proteins shown in Table 5C.

TABLE 5C

PatP Results for NOV5

| Sequences Producing High-Scoring Segment Pairs: | High Score | Smallest Sum Prob P (N) |
|---|---|---|
| patp: AAB58356 Lung cancer associated polypeptide sequence - human | 467 | 4.0e–44 |
| patp: AAB45541 Human S100A11 protein - Homo sapiens | 467 | 4.0e–44 |
| patp: AAU31484 Novel human secreted protein #1975 | 232 | 3.2e–19 |
| patp: AAB45531 Human S100A1 protein | 167 | 2.5e–12 |
| patp: AAM40258 Human polypeptide | 167 | 2.5e–12 |

In a BLAST search of public sequence databases, it was found, for example, that the NOV5 nucleic acid sequence of this invention has 305 of 335 bases (91%) identical to a

TABLE 5A

NOV5 Nucleotide Sequence (SEQ ID NO:11)

CTCCAACATGGCAAAAATCTCCAGCCCTACAGAGACTGTGCGGTGCATTCAGTCCCTGATTGCTGTTTTCCAGAA
GTATGCTGGAAAGGATGGTTACAACCGCAATCTCTCCAAGACGGAGTTCCTAAGCTTCATGAATACAGAGCTGGC
TGCCTTTACAAAGAACCAGAAGGACCCCGGTGTCCTTGACCGCATGAAGAAACTGGATGTCAGCAGCGATGGGCA
GTTAGATTTCCCAAAATTTCTTAATCTGATTGGCGGCCTAGCTGTGGCTTGCCATGACTCCTTCCTCAAGGCTGT
CCCTTCCCAGAAGTGGAACTGAGGACCCCATG

The NOV5 protein (SEQ ID NO:12) encoded by SEQ ID NO:11 is 104 amino acid residues in length and is presented using the one-letter amino acid code in Table 5B. The SignalP, Psort and/or Hydropathy results indicate that NOV5 has no known signal peptide and is likely to be localized in the mitochondrial matrix space with a certainty of 0.5964. Alternatively, a NOV5 polypeptide is located to the mitochondrial inner membrane with a certainty of 0.3037, the mitochondrial intermembrane space with a certainty of 0.3037, or the mitochondrial outer membrane with a certainty of 0.3037.

gb:GENBANK-ID:HUMS100CP1|acc:D49355.1 mRNA from Human mRNA for S100C protein, complete cds. Further, the full amino acid sequence of the disclosed NOV5 protein of the invention has 102 of 103 amino acid residues (99%) identical to, and 102 of 103 amino acid residues (99%) similar to, the 104 amino acid residue ptnr:SP-TREMBL-ACC:Q9UDP3 protein from Human (WUGSC:_H0456N16.1 PROTEIN).

The NOV5 protein of the invention also has homolgy to the proteins shown in the BLASTP data in Table 5D.

TABLE 5B

Encoded NOV5 Protein Sequence (SEQ ID NO:12)

MAKISSPTETVRCIQSLIAVFQKYAGKDGYNRNLSKTEFLSFMNTELAAFTKNQKDPGVLDRMKKLDVSSDGQLD
FPKFLNLIGGLAVACHDSFLKAVPSQKWN

TABLE 5D

NOV5 BLASTP Results

| Gene Index/ Identifier | Protein/Organism | Length of aa | Identity (%) | Positives (%) | Expect Value |
|---|---|---|---|---|---|
| Q9UDP3 | Putative S100 calcium-binding protein H_NH0456N16.1 - *Homo sapiens* (Human) | 104 | 102/103 (99%) | 102/103 (99%) | 6.0e−50 |
| O60417 | S100 calcium-binding protein A14 - *Homo sapiens* (Human) | 102 | 99/102 (97%) | 100/102 (98%) | 3.8e−48 |
| P31949 | Calgizzarin (S100C protein) (MLN 70) - *Homo sapiens* (Human) | 105 | 93/103 (90%) | 97/103 (94%) | 5.2e−44 |
| P24480 | Calgizzarin (S100C protein) - *Oryctolagus cuniculus* (Rabbit) | 102 | 83/100 (83%) | 92/100 (92%) | 3.0e−39 |
| P50543 | Calgizzarin (Endothelial monocyte-activating polypeptide) (EMAP) - *Mus musculus* (Mouse) | 98 | 79/96 (82%) | 87/96 (90%) | 1.7e−36 |

A multiple sequence alignment is given in Table 5E, with the NOV5 protein of the invention being shown in line 1 in a ClustalW analysis comparing NOV5 with related protein sequences of Table 5D.

Table 5E. ClustalW Analysis of NOV5

1. SEQ ID NO.: 12 NOV5
2. SEQ ID NO.: 150 Q9UDP3
3. SEQ ID NO.: 151 O60417
4. SEQ ID NO.: 152 P31949
5. SEQ ID NO.: 153 P24480
6. SEQ ID NO.: 154 P50543

```
                10        20        30        40        50        60
        ....|....|....|....|....|....|....|....|....|....|....|....|
NOV5    MAKISSPTETVRCIQSLIAVFQKYAGKDGYNRNLSKTEFLSFMNTELAAFTKNQKDPGVL  60
Q9UDP3  MAKISSPTETVRCIQSLIAVFQKYAGKDGYNCNLSKTEFLSFMNTELAAFTKNQKDPGVL  60
O60417  MAKISSPTETERCIESLIAVFQKYAGKDGYNRNLSKTEFLSFMNTELAAFTKNQKDPGVL  60
P31949  MAKISSPTETERCIESLIAVFQKYAGKDGYNYTLSKTEFLSFMNTELAAFTKNQKDPGVL  60
P24480  ---MSRPTETERCIESLIAVFQKYAGKDGHSVTLSKTEFLSFMNTELAAFTKNQKDPGVL  57
P50543  -----MPTETERCIESLIAVFQKYSGKDGNNTQLSKTEFLSFMNTELAAFTKNQKDPGVL  55

70        80        90       100
        ....|....|....|....|....|....|....|....|
NOV5    DR-MKKLDVSSDGQLDFPKFLNLIGGLAVACHDSFLKAVPSQKWN 104
Q9UDP3  DR-MKKLDVSSDGQLDFPKFLNLIGGLAVACHDSFLKAVPSQKWT 104
```

```
O60417    DH-MKKLDVSSDGQLDFPKFLNLIGGLAVACHDSFLKAVPSQK--  102
P31949    DRMMKKLDTNSDGQLDFSEFLNLIGGLAMACHDSFLKAVPSQKRT  105
P24480    DRMMKKLDLNSDGQLDFQEFLNLIGGLAVACHESFVKAAPPQKRF  102
P50543    DRMMKKLDLNCDGQLDFQEFLNLIGGLATACHDSFLQTS--QKRI   98
```

The presence of identifiable domains in the disclosed NOV5 protein was determined by using Pfam and then determining the Interpro number. The results are listed in Table 5F with the statistics and domain description.

polypeptide, antibodies and related compounds according to the invention may be used to treat genetic conditions, e.g., various cancers like breast, lung, and colorectal, as well as heart disease such as myocardial ischemia.

TABLE 5F

Domain Analysis of NOV5

| PSSMs Producing Significant Alignments | Score (bits) | E Value |
|---|---|---|
| S_100: domain 1 of 1, from 10 to 53 | 59.2 | 8.8e-14 |

| | | |
|---|---|---|
| S-100 | LEkaietiInvFhqYSgreGdkdtLsKkELKeLlekELpnfLkn | (SEQ ID NO:155) |
| | + +++ ++\|++\|++\|++++\| +  \|+\|  \|+  ++++\|\|+ ++++ | |
| NOV5 | TVRCIQSLIAVFQKYAGKDGYNRNLSKTEFLSFMNTELAAFTKN | (SEQ ID NO:12) |

Consistent with other known members of the S100 family of proteins, NOV5 contains S100 calcium binding domains as illustrated in Table 5F.

The NOV5 nucleic acid, and the encoded polypeptide, according to the invention are useful in a variety of applications and contexts. For example, NOV5 nucleic acids and polypeptides can be used to identify proteins that are members of the S100 family of proteins. The NOV5 nucleic acids and polypeptides can also be used to screen for molecules, which inhibit or enhance NOV5 activity or function. Specifically, the nucleic acids and polypeptides according to the invention may be used as targets for the identification of small molecules that modulate or inhibit, e.g., calcium regulation. These molecules can be used to treat, e.g., various cancers like breast, lung, or colorectal.

In addition, the NOV5 nucleic acid and polypeptide according to the invention are useful, inter alia, as novel members of the protein families according to the presence of domains and sequence relatedness to previously described proteins. For example, the NOV5 nucleic acid and polypeptide include structural motifs that are characteristic of proteins belonging to the family of S100 proteins. S100 proteins are expressed in a cell-type specific manner in higher organisms, including humans, and are involved in the calcium-regulated control of very diverse cellular processes. Proteins of the S100 family belong to the large group of EF-hand calcium-binding proteins.

The NOV5 nucleic acid and polypeptide, antibodies and related compounds according to the invention will be useful in therapeutic and diagnostic applications in the mediation of calcium regulation. As such the NOV5 nucleic acid and The NOV5 nucleic acid and polypeptide are useful for detecting specific cell types. For example, expression analysis has demonstrated that a NOV5 nucleic acid is expressed in elevated levels in colorectal cancers compared with that of normal colorectal mucosa, as well as in breast cancer-derived metastatic axillary lymph nodes, but not in normal lymph nodes or breast fibroadenomas. Accordingly, the NOV5 nucleic acids and polypeptides, antibodies and related compounds according to the invention will have diagnostic and therapeutic applications in the detection of cancer, e.g., breast or colorectal cancer. A NOV5 nucleic acid is also expressed in brain, lung, smooth muscle and keratinocyte tissue.

Additional utilities for the NOV5 nucleic acid and polypeptide according to the invention are disclosed herein.

NOV6

The disclosed NOV6 nucleic acid (alternatively referred to herein as CG56048-01) encodes a novel olfactory receptor-like protein/G-protein coupled receptor (GPCR) protein and includes the 11121 nucleotide sequence (SEQ ID NO:13) shown in Table 6A.

An open reading frame for the mature protein was identified beginning with an ATG initiation codon at nucleotides 30–32, and ending with a TAG stop codon at nucleotides 1119–1121. Putative untranslated regions, if any, are found upstream from the initiation codon and downstream from the termination codon. The start and stop codons are in bold letters.

TABLE 6A

NOV6 Nucleotide Sequence (SEQ ID NO:13)

<u>TTATTTCAAAAACTTTCGATACTGCTCCT</u>ATGGCTCCCCATGTCCGAATATGTATGCCCTTGACGGACGGCATTT
CTTCATTTGAGGACCTCTTGGCTAACAATATCCTCAGAATATTTGTCTGGGTTATAGCTTTCATTACCTGCTTTG
GAAATCTTTTTGTCATTGGCATGAGATCTTTCATTAAAGCTGAAAATACAACTCACGCTATGTCCATCAAAATCC
TTTGTTGTGCTGATTGCCTGATGGGTGTTTACTTGTTCTTTGTTGGCATTTTCGATATAAAATACCGAGGGCAGT
ATCAGAAGTATGCCTTGCTGTGGATGGAGAGCGTGCAGTGCCGCCTCATGGGGTTCCTGGCCATGCTGTCCACCG
AAGTCTCTGTTCTGCTACTGACCTACTTGACTTTGGAGAAGTTCCTGGTCATTGTCTTCCCCTTCAGTAACATTC
GACCTGGAAAACGGCAGACCTCAGTCATCCTCATTTGCATCTGGATGGCGGGATTTTTAATAGCTGTAATTCCAT

TABLE 6A-continued

NOV6 Nucleotide Sequence (SEQ ID NO:13)

TTTGGAATAAGGATTATTTTGGAAACTTTTATGGGAAAAATGGAGTATGTTTCCCACTTTATTATGACCAAACAG
AAGATATTGGAAGCAAAGGGTATTCTCTTGGAATTTTCCTAGGTGTGAACTTGCTGGCTTTTCTCGTCATTGTGT
TTTCCTATATTACTATGTTCTGTTCCATTCAAAAAACCGCCTTGCAGACCACAGAAGTAAGGAATTGTTTTGGAA
GAGAGGTGGCTGTTGCAAATCGTTTCTTTTTTATAGTGTTCTCTGATGCCATCTGCTGGATTCCTGTATTTGTAG
TTAAAATCCTTTCCCTCTTCCGGGTGGAAATTCCAGACACAATGACTTCCTGGATAGTGATTTTTTTCCTTCCAG
TTAACAGTGCTTTGAATCCAATCCTCTATACTCTCACAACCAACTTTTTTAAGGACAAGTTGAAACAGCTGCTGC
ACAAACATCAGAGGAAATCAATTTTCAAAATTAAAAAAAAAAGTTTATCTACATCCATTGTGTGGATAGAGGACT
CCTCTTCCCTGAAACTTGGGGTTTTGAACAAAATAACACTTGGAGACAGTATAATGAAACCAGTTTCCTAG

The NOV6 protein (SEQ ID NO:14) encoded by SEQ ID NO:13 is 363 amino acid residues in length and is presented using the one-letter amino acid code in Table 6B. The SignalP, Psort and/or Hydropathy results indicate that NOV6 has a signal peptide and is likely to be localized in the plasma membrane with a certainty of 0.6000. Alternatively, a NOV6 polypeptide is located to the Golgi body with a certainty of 0.4000, the endoplasmic reticulum (membrane) with a certainty of 0.3000, or the mitochondrial inner membrane with a certainty of 0.0300. The SignalP indicates a likely cleavage site for a NOV6 polypeptide is between positions 41 and 42, i.e., at the dash in the sequence CFG-NL.

TABLE 6B

Encoded NOV6 Protein Sequence (SEQ ID NO:14)

MAPHVRICMPLTDGISSFEDLLANNILRIFVWVIAFITCFGNLFVIGMRSFIKAENTTHAMSIKILCCADCLMGV
YLFFVGIFDIKYRGQYQKYALLWMESVQCRLMGFLAMLSTEVSVLLLTYLTLEKFLVIVFPFSNIRPGKRQTSVI
LICIWMAGFLIAVIPFWNKDYFGNFYGKNGVCFPLYYDQTEDIGSKGYSLGIFLGVNLLAFLVIVFSYITMFCSI
QKTALQTTEVRNCFGREVAVANRFFFIVFSDAICWIPVFVVKILSLFRVEIPDTMTSWIVIFFLPVNSALNPILY
TLTTNFFKDKLKQLLHKHQRKSIFKIKKKSLSTSIVWIEDSSSLKLGVLNKITLGDSIMKPVS

SNP variants of NOV6 are disclosed in Example 2.

A search against the Patp database, a proprietary database that contains sequences published in patents and patent publication, yielded several homologous proteins shown in Table 6C.

TABLE 6C

PatP Results for NOV6

| Sequences Producing High-Scoring Segment Pairs: | High Score | Smallest Sum Prob P (N) |
| --- | --- | --- |
| patp: AAU04370 Human G-protein coupled receptor, hRUP16 | 1840 | 1.3e−189 |
| patp: AAY42170 Human LGR7 long form protein sequence | 1117 | 5.3e−113 |
| patp: AAY42171 Human LGR7 short form protein sequence | 1117 | 5.3e−113 |

TABLE 6C-continued

PatP Results for NOV6

| Sequences Producing High-Scoring Segment Pairs: | High Score | Smallest Sum Prob P (N) |
| --- | --- | --- |
| patp: AAE02498 Human CON222 G protein-coupled receptor protein | 1117 | 5.3e−113 |
| patp: AAY57286 Human GPCR protein (HGPRP) sequence (clone ID 2488822) | 1111 | 2.3e−112 |

In a BLAST search of public sequence databases, it was found, for example, that the NOV6 nucleic acid sequence of this invention has 723 of 1057 bases (68%) identical to a gb:GENBANK-ID:AF190500|acc:AF190500.1 mRNA from Homo sapiens leucine-rich repeat-containing G protein-coupled receptor 7 (LGR7) mRNA, complete cds. Further, the fall amino acid sequence of the disclosed NOV6 protein of the invention has 203 of 339 amino acid residues (59%) identical to, and 271 of 339 amino acid residues (79%) similar to, the 757 amino acid residue ptnr:TREM-BLNEW-ACC:AAG17167 protein from Human (LEUCINE-RICH REPEAT-CONTAINING G PROTEIN-COUPLED RECEPTOR 7).

The NOV6 protein of the invention also has homolgy to the proteins shown in the BLASTP data in Table 6D.

TABLE 6D

NOV6 BLASTP Results

| Gene Index/ Identifier | Protein/Organism | Length of aa | Identity (%) | Positives (%) | Expect Value |
|---|---|---|---|---|---|
| Q91ZZ5 | G PROTEIN COUPLED RECEPTOR AFFECTING TESTICULAR DESCENT - *Mus musculus* (Mouse) | 737 | 304/361 (84%) | 326/361 (90%) | 3.6e−162 |
| Q9HBX9 | LEUCINE-RICH REPEAT-CONTAINING G PROTEIN-COUPLED RECEPTOR 7 - *Homo sapiens* (Human) | 757 | 203/339 (59%) | 271/339 (79%) | 6.8e−113 |
| CAC38938 | SEQUENCE 15 FROM PATENT WO0131014 - *Homo sapiens* (Human) | 396 | 203/339 (59%) | 271/339 (79%) | 6.8e−113 |
| Q9VBP0 | CG5042 PROTEIN - *Drosophila melanogaster* (Fruit fly) | 359 | 136/311 (43%) | 194/311 (62%) | 3.1e−62 |
| P46023 | G-protein coupled receptor GRL101 precursor - *Lymnaea stagnalis* (Great pond snail) | 1115 | 128/343 (37%) | 198/343 (57%) | 2.7e−56 |

A multiple sequence alignment is given in Table 6E, with the NOV6 protein of the invention being shown in line 1 in a ClustalW analysis comparing NOV6 with related protein sequences of Table 6D.

Table 6E. ClustalW Analysis of NOV6

1. SEQ ID NO.: 14    NOV6
2. SEQ ID NO.: 156    Q91ZZ5
3. SEQ ID NO.: 157    Q9HBX9
4. SEQ ID NO.: 158    CAC38938
5. SEQ ID NO.: 159    Q9VBP0
6. SEQ ID NO.: 160    P46023

```
                 10        20        30        40        50        60
            ....|....|....|....|....|....|....|....|....|....|....|....|
NOV6        ------------------------------------------------------------ 1
Q91ZZ5      ------------------------------------------------------------ 1
Q9HBX9      ------------------------------------------------------------ 1
CAC38938    ------------------------------------------------------------ 1
Q9VBP0      ------------------------------------------------------------ 1
P46023      MATMSGTTIVCLIYLTTMLGNSQGVNLKIESPSPPTLCSVEGTFHCDDGMLQCVLMGSKC 60

70        80        90       100       110       120
            ....|....|....|....|....|....|....|....|....|....|....|....|
NOV6        ------------------------------------------------------------ 1
Q91ZZ5      ------------------------------------------------------------ 1
Q9HBX9      ------------------------------------------------------------ 1
CAC38938    ------------------------------------------------------------ 1
Q9VBP0      ------------------------------------------------------------ 1
P46023      DGVSDCENGMDESVETCGCLQSEFQCNHTTCIDKILRCDRNDDCSNGLDERECDIYICPL 120

130       140       150       160       170       180
            ....|....|....|....|....|....|....|....|....|....|....|....|
NOV6        ------------------------------------------------------------ 1
Q91ZZ5      ------------------------------------------------------------ 1
Q9HBX9      ------------------------------------------------------------ 1
CAC38938    ------------------------------------------------------------ 1
Q9VBP0      ------------------------------------------------------------ 1
P46023      GTHVKWHNHFCVPRDKQCDFLDDCGDNSDEKICERRECVATEFKCNNSQCVAFGNLCDGL 180

190       200       210       220       230       240
            ....|....|....|....|....|....|....|....|....|....|....|....|
NOV6        ------------------------------------------------------------ 1
Q91ZZ5      ------------------------------------------------------------ 1
Q9HBX9      ------------------------------------------------------------ 1
CAC38938    ------------------------------------------------------------ 1
Q9VBP0      ------------------------------------------------------------ 1
P46023      VDCVDGSDEDQVACDSDKYFQCAEGSLIKKEFVCDGWVDCKLTFADELNCKLCDEDDFRC 240

250       260       270       280       290       300
            ....|....|....|....|....|....|....|....|....|....|....|....|
NOV6        ------------------------------------------------------------ 1
Q91ZZ5      ------------------------------------------------------------ 1
```

```
Q9HBX9      ------------------------------------------------------   1
CAC38938    ------------------------------------------------------   1
Q9VBP0      ------------------------------------------------------   1
P46023      SDTRCIQKSNVCDGYCDCKTCDDEEVCANNTYGCPMDTKYMCRSIYGEPRCIDKDNVCNM 300

310       320       330       340       350       360
                 ....|....|....|....|....|....|....|....|....|....|....|....|
NOV6        ------------------------------------------------------------   1
Q91ZZ5      -------------------------------------MWLLLHVILLTEVKDFALADS  21
Q9HBX9      --------------------------------------MTSGSVFFYILIFGKYFSHG  20
CAC38938    ------------------------------------------------------------   1
Q9VBP0      ------------------------------------------------------------   1
P46023      INDCRDGNVGTDEYYCSNDSECKNFQAAMGFFYCPEERCLAKHLYCDLHPDCINGEDEQS 360

370       380       390       400       410       420
                 ....|....|....|....|....|....|....|....|....|....|....|....|
NOV6        ------------------------------------------------------------   1
Q91ZZ5      SMVAPLCPKGYFPCGNLTKCLPRAFHCDGVDDCGNGADEDNCGDTSGWTTIFGTVHGNVN  81
Q9HBX9      GGQDVKCSLGYFPCGNITKCLPQLLHCNGVDDCGNQADEDNCGDNNGWSMQFDKYFASYY  80
CAC38938    ------------------------------------------------------------   1
Q9VBP0      ------------------------------------------------------------   1
P46023      CLAPPKCSQDEFQCHHG-KCIPISKRCDSVHDCVDWSDEMNCENHQCAANMKSCLSGHCI 419

430       440       450       460       470       480
                 ....|....|....|....|....|....|....|....|....|....|....|....|
NOV6        ------------------------------------------------------------   1
Q91ZZ5      KVT-------LTQECFLS-QYPQHCYCRENELECVKADLKAVPKVSSN---VTLLSLKKN 130
Q9HBX9      KMTSQYPFEAETPECLVG-SVPVQCLCQGLELDCDETNLRAVPSVSSN---VTAMSLQWN 136
CAC38938    ------------------------------------------------------------   1
Q9VBP0      ------------------------------------------------------------   1
P46023      EEHKWCNFHRECPDGSDEKDCDPRPVCEANQFRCKNGQCIDPLQVCVKGDKYDGCADQSH 479

490       500       510       520       530       540
                 ....|....|....|....|....|....|....|....|....|....|....|....|
NOV6        ------------------------------------------------------------   1
Q91ZZ5      KIHRLPVKVFSRYTELRKIYLQHNCITHISRRAFLG----------------LHNLQIL 173
Q9HBX9      LIRKLPPDCFKNYHDLQKLYLQNNKITSISIYAFRG----------------LNSLTKL 179
CAC38938    ------------------------------------------------------------   1
Q9VBP0      ------------------------------------------------------------   1
P46023      LINCSQHICLEGQFRCRKSFCINQTKVCDGTVDCLQGMWDENNCRYWCPHGQAICQCEGV 539

550       560       570       580       590       600
                 ....|....|....|....|....|....|....|....|....|....|....|....|
NOV6        ------------------------------------------------------------   1
Q91ZZ5      YLSHNCITSLRPGIFKDLHQLAWLILDDNPITRISQKSFMGLNSLFFLPMVGNRLEALP- 232
Q9HBX9      YLSHNRITFLKPGVFEDLHRLEWLIIEDNHLSRISPPTFYGLNSLILLVLMNNVLTRLPD 239
CAC38938    ------------------------------------------------------------   1
Q9VBP0      ------------------------------------------------------------   1
P46023      TMDCTGQKLKEMPVQQMEEDLSKLMIGDNLLNLTSTTFSATYYDKVTYLDLSRNHLTEIP 599

610       620       630       640       650       660
                 ....|....|....|....|....|....|....|....|....|....|....|....|
NOV6        ------------------------------------------------------------   1
Q91ZZ5      ETLCAQMPQLNWVDLANNGIKYITNSTFLTCDSLTVLFLPRNQIGFVPEKTFSSLKNLGE 292
Q9HBX9      KPLCQHMPRLHWLDLEGNHIHNLRNLTFISCSNLTVLVMRKNKINHLNENTFAPLQKLDE 299
CAC38938    ------------------------------------------------------------   1
Q9VBP0      ------------------------------------------------------------   1
```

| | | |
|---|---|---|
| P46023 | IYSFQNMWKLTHLNLADNNITSLKNGSLLGLSNLKQLHINGNKIETIEEDTFSSMIHLTV | 659 |

```
                  670       680       690       700       710       720
              ....|....|....|....|....|....|....|....|....|....|....|....|
NOV6          ------------------------------------------------------------   1
Q91ZZ5        LDLSSNMITKLPVHLFSDLHLLQKLNLSSNPLLYVHKNQFGSLKQLQSLDLERIEIPNIS 352
Q9HBX9        LDLGSNKIENLPPLIFKDLKELSQLNLSYNPIQKIQANQFDYLVKLKSLSLEGIEISNIQ 359
CAC38938      ------------------------------------------------------------   1
Q9VBP0        ------------------------------------------------------------   1
P46023        LDLSNQRLTHVYKNMFKGLKQITVLNISRNQINSIDNGAFNNLANVRLIDLSGNVIKDIG 719

730       740       750       760       770       780
              ....|....|....|....|....|....|....|....|....|....|....|....|
NOV6          ---------------------MAPHVRICMPLTDGISSFEDLLANNILRIFVWVIAFIT  38
Q91ZZ5        TGMFQPMKNLSHIYLKTFRYCSYVPHVRICMPSTDGISSSEDLLANGILRVSVWVIAFIT 412
Q9HBX9        QRMFRPLMNLSHIYFKKFQYCGYAPHVRSCKPNTDGISSLENLLASIIQRVFVWVSAVT  419
CAC38938      --MFRPLVNLSHIYFKKFQYCGYAPHVRSCKPNTDGISSLENLLASIIQRVFVWVSAVT   58
Q9VBP0        ---------------------MTPRVRMCKPSTDGVSSFQDLISKPVLRYSAWWMATLI  38
P46023        QKVFMGLPRLVELKTDSYREFCCLAPEGVKCSPKQDEFSSCEDLMSNHVLRVSIWVLGVIA 779

790       800       810       820       830       840
              ....|....|....|....|....|....|....|....|....|....|....|....|
NOV6          CFGNLFVIGMRSFIKAENTTHAMSIKILCCADCLMGVYLFFVGIFDIKYRGQYQKYALLW  98
Q91ZZ5        CVGNFLVIAVRSLIKAENTTHAMSIKILCCADCLMGVYLFSVGVFDIKYRGQYQKYALLW 472
Q9HBX9        CFGNIFVICMRPYIRSENKLYAMSIISLCCADCLMGIYLFVIGGFDLKFRGEYNKHAQLW 479
CAC38938      CFGNIFVICMRPYIRSENKLYAMSIISLCCADCLMGIYLFVIGGFDLKFRGEYNKHAQLW 118
Q9VBP0        IAGNVLVLWGRFIYRDENVAVTMVIRNLALADMLMGFYLVTIGVQDYFYRNEYYKVVLDW  98
P46023        LVGNFVVIFWRVRDFRGGKVHSFLITNLAIGDFLMGVYLLIATADTYYRGVYISHDENW 839

850       860       870       880       890       900
              ....|....|....|....|....|....|....|....|....|....|....|....|
NOV6          MESVQCRLMGFLAMLSTEVSVLLLTVLTLEKFLVIVEPFSNIR-PGKRCTSVILICIWMA 157
Q91ZZ5        MESVPCRLLGFLATLSTEVSVLLLTFLTLEKFLVIVEPFSNLR-LGKRCTAVALASIWVV 531
Q9HBX9        MESTHCQLVGSLAILSTEVSVLLLTFLTLEKYICIVYPFRCVR-PGKCRIITVLILIWT  538
CAC38938      MESTHCQLVGSLAILSTEVSVLLLTFLTLEKYICIVYPFRCVR-PGKCRIITVLILIWT  177
Q9VBP0        ITSWQCTLIGTLAVSSSEVSMLILAFMSLERFLLIADPFRGHRSIGNRVMWLALICIWIT 158
P46023        KQSGLCQFAGFVSTFSSELSVLTLSTITLDRLICILFPLRRTR-LGLRQAIIVMSCIWVL 898

910       920       930       940       950       960
              ....|....|....|....|....|....|....|....|....|....|....|....|
NOV6          --GFLIAVIPFWNKDYFGNFYGKNGVCFPLYYDQTEDIGSKGYSLGIFLGVNLLAFLVIV 215
Q91ZZ5        --GFLIAAVPFTREDYFGNFYGKNGVCFPLHYDQAEDFGSRGYSLGIFLGVNLLAFLVIV 589
Q9HBX9        --GFIVAFIPLSNKEFFKNYYGTNGVCFPLHSEDTESIGAQIYSVAIFLGINLAAFIIV  596
CAC38938      --GFIVAFIPLSNKEFFKNYYGTNGVCFPLHSEDTESIGAQIYSVAIFLGINLAAFIIV  235
Q9VBP0        GVGLAVAPVLLWRTSTLPYYGSYSGTCFPLHIHEAFPMG-WLYSAFVFLGVNLLLVMIA 217
P46023        --VFLLAVLPLLGFSYFENYYGRSGVCLALHVTPDRRPG-WEYSVGVFILLNLLSFVLIA 955

970       980       990      1000      1010      1020
              ....|....|....|....|....|....|....|....|....|....|....|....|
NOV6          FSYIMMFCSIQKTALQTTEVRNCFGREVAVANRFFFIVFSDALCWIPVFVVKILSLFRVE 275
Q91ZZ5        ISYVMMFCSIHKTALQTAEVRSHIGKEVAVANRFFFIVFSDALCWIPVFVVKILSLLQVE 649
Q9HBX9        FSYGSMFYSVHQSAITATEIRNQVKKEMILAKRFFFIVFTDALCWIPIFVVKFLSLLQVE 656
CAC38938      FSYGSMFYSVHQSAITATEIRNQVKKEMILAKRFFFIVFTDALCWIPIFVVKFLSLLQVE 295
Q9VBP0        MLYTALLISIWRTRSATPLT----LLDCEFAVRFFFIVLTDFLCWMPIIVMKIWVFFNYN 273
P46023        SSYLWMFSVAKKTRSAVRTAES--KNDNAMARRMTLIVMTDFCCWPIIVLGFVSLAGAR 1013

1030      1040      1050      1060      1070      1080
```

```
NOV6      IPDTMTSWIVIFFLPVNSALNPILYTLTTNFFKDKLKQLLHKHQ-RKSIFKIKKKSLSTS  334
Q91ZZ5    IPGTITSWIVVFFLPVNSALNPILYTLTTSFFKDKLKQLLHKHR-RKPIFKVKKKSLSAS  708
Q9HBX9    IPGTITSWVVIFILPINSALNPILYTLTTRPFKEMIHRFWYNYRQRKSMDSKGQKTYAPS  716
CAC38938  IPGTITSWVVIFILPINSALNPILYTLTTRPFKEMIHRFWYNYRQRKSMDSKGQKTYAPS  355
Q9VBP0    ISDDIYAWLVVFVLPLNSAVNPLLYTFTTPKYRNQIFLRGWRKITSRKRAEAGNGNVATT  333
P46023    ADDQVYAWIAVFVLPLNSATNPVIYTLSTAPFLGNVRKRANRFRKSFIHSFTGDTKHSYV  1073

1090      1100      1110      1120
NOV6      IVWIEDSSSLKLG-VLNKITLG--DSIMKPVS-----------  363
Q91ZZ5    IVWTDESS-LKLG-VLSKIALG--DSIMKPVSP----------  737
Q9HBX9    FIWVEMWPLQEMPPELMKPDLFTYPCEMSLISQSTRLNSYS--  757
CAC38938  FIWVEMWPLQEMPPELMKPDLFTYPCEMSLISQSTRLNSYS--  396
Q9VBP0    TTGTATGS-SQHP---DDFTIFA-KAAMRCH------------  359
P46023    DDGTTHSYCEKKS-PYRQLELKRLRSLNSSPPMYYNTELHSDS  1115
```

The presence of identifiable domains in the disclosed NOV6 protein was determined by using Pfam and then determining the Interpro number. The results are listed in Table 6F with the statistics and domain description.

TABLE 6F

Domain Analysis of NOV6

```
                                            Score      E
PSSMs Producing Significant Alignments      (bits)    Value 7tm_1: domain 1 of 1, from 101 to 300        61.1    1.4e-18

7tm_1       salCklvtaldvvnmyaSillLtaISiDRYlAIvhPlryrrrrtspr
            ++  |++ +++   +++ +|+++|+ ++++ +++|+ |++  +      +
NOV6        SVQCRLMGFLAMLSTEVSVLLLTYLTLEKFLVIVFPFSNIRPGK--R 7tm_1       rAkvvillvWvlalllslPpllfswvktveegngtlnvnvtvClidfpee
            +  ++++++|  +++++++++   + ++++  +++          +|++ +  +
NOV6        QTSVILICIWMAGFLIAVIP--F-WNKDYFGNFY---GKNGVCFPLYYDQ 7tm_1       stasvstwlrsyvllstlvgFllPllvilvcYtrIlrtlr..........
            +   + + ++++ + +++++ ++ ++++++  |   +++ ++++  ++++ +
NOV6        T---EDIGSKGYSLGIFLGVNLLAFLVIVFSYITMFCSIQktalqttevr 7tm_1       .......kaaktllvvvvvFvlCWlPyfivllldtlc.lsiimsstCele
            +   +++  ++   + +++  ++|  |  |  +++ ++  +   +
NOV6        ncfgrevAVANRFFFIVFSDAICWIPVFVVKILSLFRvEI----------

7tm_1       rvlptallvtlwLay.vNsclNPiIY        (SEQ ID NO:161)
            ++++++++++ +   ++|+++||++|
NOV6        --PDTMTSWIVIFFLpVNSALNPILY        (SEQ ID NO:14)
```

Consistent with other known members of the olfactory receptor family of proteins, NOV6 contains 7-transmembrane domains as illustrated in Table 6F.

The NOV6 nucleic acid, and the encoded polypeptide, according to the invention are useful in a variety of applications and contexts. For example, NOV6 nucleic acids and polypeptides can be used to identify proteins that are members of the olfactory receptor family of proteins. The NOV6 nucleic acids and polypeptides can also be used to screen for molecules, which inhibit or enhance NOV6 activity or function. Specifically, the nucleic acids and polypeptides according to the invention may be used as targets for the identification of small molecules that modulate or inhibit, e.g., cellular recognition, or G-protein-mediated transduction of odorant signals. These molecules can be used to treat, e.g., taste and scent detectability disorders, immune diseases, or signal transduction pathways.

In addition, the NOV6 nucleic acid and polypeptide according to the invention are useful, inter alia, as novel members of the protein families according to the presence of domains and sequence relatedness to previously described proteins. For example, the NOV6 nucleic acid and polypeptide include structural motifs that are characteristic of proteins belonging to the family of olfactory receptor proteins. Olfactory receptors have great variety, exquisite specificity, high sensitivity and fast response. The human olfactory epithelium contains two to three thousand distinct olfactory receptors, a class of G-protein coupled receptors. The receptors consist of seven hydrophobic segments that span the cell membrane (trans-membrane domains I–VII), separated by hydrophilic segments that project into the intra- or extra-cellular space. Transmembrane domains II–VII comprise a hypervariable segment that defines the ligand specificity of the receptor.

The NOV6 nucleic acid and polypeptide, antibodies and related compounds according to the invention will be useful in therapeutic and diagnostic applications in the mediation of signal transduction. As such the NOV6 nucleic acid and polypeptide, antibodies and related compounds according to the invention may be used to treat, e.g., developmental diseases, MHC II and III diseases (immune diseases), taste and scent detectability disorders, Burkitt's lymphoma, corticoneurogenic disease, signal transduction pathway disorders, retinal diseases including those involving photoreception, cell growth rate disorders, cell shape disorders, feeding disorders, control of feeding, potential obesity due to overeating, potential disorders due to starvation (lack of apetite), noninsulin-dependent diabetes mellitus (NIDDM1), bacterial, fungal, protozoal and viral infections (particularly infections caused by HIV-1 or HIV-2), pain, cancer (including but not limited to neoplasm, adenocarcinoma, lymphoma, prostate cancer, uterus cancer), anorexia, bulimia, asthma, parkinson's disease, acute heart failure, hypotension, hypertension, urinary retention, osteoporosis, crohn's disease, multiple sclerosis, and treatment of albright hereditary osteoedystrophy, angina pectoris, myocardial infarction, ulcers, asthma, allergies, benign prostatic hypertrophy, and psychotic and neurological disorders, including anxiety, schizophrenia, manic depression, delirium, dementia, severe mental retardation, dentatorubro-pallidoluysian atrophy (DRPLA) hypophosphatemic rickets, autosomal dominant (2) acrocallosal syndrome and dyskinesias, such as huntington's disease or gilles de la tourette syndrome. The NOV6 nucleic acid and polypeptide are useful for detecting specific cell types. For example, expression analysis has demonstrated that a NOV6 nucleic acid is predominantly expressed in olfactory epithelium and taste receptor cells of the tongue.

Additional utilities for the NOV6 nucleic acid and polypeptide according to the invention are disclosed herein.

NOV7

The NOV7 proteins descibed herein are novel carbonate dehydratase-like proteins. The NOV7 nucleic acids disclosed herein map to chromosome 15. Two alternative novel NOV7 nucleic acids and polypeptides are disclosed herein, namely NOV7a and NOV7b.

NOV7a

A NOV7 variant is NOV7a (alternatively referred to herein as CG50365-01), which encodes the 828 nucleotide sequence (SEQ ID NO:15) shown in Table 7A. An open reading frame for the mature protein was identified beginning with an ATG codon at nucleotides 16–18 and ending with a TAA codon at nucleotides 802–804. Putative untranslated regions, if any, downstream from the termination codon and upstream from the initiation codon are underlined. The start and stop codons are in bold letters.

TABLE 7A

NOV7a Nucleotide Sequence (SEQ ID NO:15)

CCACCCCGAGGGACCATGTCGAGGCTCAGCTGGGGATACCGCGAGCACAACGGTCCTATTCACTGGAAGGAATTT
TTCCCTATTGCTGATGGTGATCAGCAATCTCCAATTGAGATTAAAACCAAAGAAGTGAAATATGACTCTTCCCTC
CGACCACTTAGTATCAAGTATGACCCAAGCTCAGCTAAAATCATCAGCAACAGCGGCCATTCCTTCAATGTTGAC
TTTGATGACACAGAGAACAAATCAGTTCTGCGTGGTGGTCCTCTCACTGGAAGCTACAGGTTACGGCAGGTTCAC
CTTCACTGGGGGTCCGCTGATGACCACGGCTCCGAGCACATAGTAGATGGAGTGAGCTATGCTGCAGAGCTCCAT
GTTGTTCACTGGAATTCAGACAAATACCCCAGCTTTGTTGAGGCAGCTCATGAACCAGATGGACTGGCTGTCTTG
GGAGTGTTTTTACAGGTGGGTGAACCTAATTCCCAACTGCAAAAGATTACTGACACTTTGGATTCCATTAAAGAA
AAGGGGTAAACAAACTCGATTCACAAATTTTGACCTATTGTCTCTGCTTCCACCATCCTGGGACTACTGGACATAT
CCTGGTTCTCTTACAGTTCCACCTCTTCTTGAGAGTGTCACATGGATTGTTTTAAAGCAACCTATAAACATCAGC
TCTCAACAGCTGGCCAAATTTCGCAGTCTCCTGTGCACAGCGGAGGGTGAAGCAGCAGCTTTTCTGGTGAGCAAT
CACCGCCCACCACAGCCTCTAAAGGGCCGCAAAGTGAGAGCCTCTTTCCATTAAAAATTGTCACCAATGAACTCC
CCC

The NOV7a protein (SEQ ID NO:16) encoded by SEQ ID NO:15 is 262 amino acid residues in length and is presented using the one-letter amino acid code in Table 7B. The SignalP, Psort and/or Hydropathy results indicate that NOV7a has no known signal peptide and is likely to be localized in the microbody peroxisome) with a certainty of 0.7480. Alternatively, a NOV7a polypeptide is located to the mitochondrial matrix space with a certainty of 0.1000, the lysosome (lumen) with a certainty of 0.1000, or the endoplasmic reticulum (membrane) with a certainty of 0.1000.

TABLE 7B

Encoded NOV7a Protein Sequence (SEQ ID NO:16)

MSRLSWGYREHNGPIHWKEFFPIADGDQQSPIEIKTKEVKYDSSLRPLSIKYDPSSAKIISNSGHSFNVDFDDTE
NKSVLRGGPLTGSYRLRQVHLHWGSADDHGSEHIVDGVSYAAELHVVHWNSDKYPSFVEAAHEPDGLAVLGVFLQ
VGEPNSQLQKITDTLDSIKEKGKQTRFTNFDLLSLLPPSWDYWTYPGSLTVPPLLESVTWIVLKQPINISSQQLA
KFRSLLCTAEGEAAAFLVSNHRPPQPLKGRKVRASFH

NOV7b

Alternatively, a NOV7 variant is NOV7b (alternatively referred to herein as CG50365-02), which includes the 833 nucleotide sequence (SEQ ID NO:17) shown in Table 7C. An open reading frame for the mature protein was identified beginning with an ATG codon at nucleotides 21–23 and ending with a TAA codon at nucleotides 807–809. Putative untranslated regions, if any, downstream from the termination codon and upstream from the initiation codon are underlined. The start and stop codons are in bold letters.

TABLE 7C

NOV7b Nucleotide Sequence (SEQ ID NO:17)

ATGTCGAGGCTCAGCTGGGGATGTCGAGGCTCAGCTGGGGATACCGCGAGCACAACGGTCCTATTCACTGGAAGG

AATTTTTCCCTATTGCTGATGGTGATCAGCAATCTCCAATTGAGATTAAAACCAAAGAAGTGAAATATGACTCTT

CCCTCCGACCACTTAGTATCAAGTATGACCCAAGCTCAGCTAAAATCATCAGCAACAGCGGCCATTCCTTCAATG

TTGACTTTGATGACACAGAGAACAAATCAGTTCTGCGTGGTGGTCCTCTCACTGGAAGCTACAGGTTACGGCAGG

TTCACCTTCACTGGGGGTCCGCTGATGACCACGGCTCCGAGCACATAGTAGATGGAGTGAGCTATGCTGCAGAGC

TCCATGTTGTTCACTGGAATTCAGACAAATACCCCAGCTTTGTTGAGGCAGCTCATGAACCAGATGGACTGGCTG

TABLE 7C-continued

NOV7b Nucleotide Sequence (SEQ ID NO:17)

TCTTGGGAGTGTTTTTACAGATTGGTGAACCTAATTCCCAACTGCAAAAGATTACTGACACTTTGGATTCCATTA

AAGAAAAGGGTAAACAAACTCGATTCACAAATTTTGACCTATTGTCTCTGCTTCCACCATCCTGGGACTACTGGA

CATATCCTGGTTCTCTTACAGTTCCACCTCTTCTTGAGAGTGTCACATGGATTGTTTTAAAGCAACCTATAAACA

TCAGCTCTCAACAGCTGGCCAAATTTCGCAGTCTCCTGTGCACAGCGGAGGGTGAAGCAGCAGCTTTTCTGGTGA

GCAATCACCGCCCACCACAGCCTCTAAAGGGCCGCAAAGTGAGAGCCTCTTTCCATTAAAAATTGTCACCAATGA

ACTCCCCC

The NOV7b protein (SEQ ID NO:18) encoded by SEQ ID NO:17 is 262 amino acid residues in length and is presented using the one-letter amino acid code in Table 7D. The SignalP, Psort and/or Hydropathy results indicate that NOV7b has no known signal peptide and is likely to be localized in the microbody (peroxisome) with a certainty of 0.7480. Alternatively, a NOV7b polypeptide is located to the mitochondrial matrix space with a certainty of 0.1000, the lysosome (lumen) with a certainty of 0.1000, or the endoplasmic reticulum (membrane) with a certainty of 0.1000.

TABLE 7D

Encoded NOV7b Protein Sequence (SEQ ID NO:18)

MSRLSWGYREHNGPIHWKEFFPIADGDQQSPIEIKTKEVKYDSSLRPLSIKYDPSSAKIISNSGHSFNVDFDDTE

NKSVLRGGPLTGSYRLRQVHLHWGSADDHGSEHIVDGVSYAAELHVVHWNSDKYPSFVEAAHEPDGLAVLGVFLQ

IGEPNSQLQKITDTLDSIKEKGKQTRFTNFDLLSLLPPSWDYWTYPGSLTVPPLLESVTWIVLKQPINISSQQLA

KFRSLLCTAEGEAAAFLVSNHRPPQPLKGRKVRASFH

NOV7 Clones

Unless specifically addressed as NOV7a or NOV7b, any reference to NOV7 is assumed to encompass all variants.

A search against the Patp database, a proprietary database that contains sequences published in patents and patent publication, yielded several homologous proteins shown in Table 7E.

TABLE 7E

PatP Results for NOV7

| Sequences Producing High-Scoring Segment Pairs: | High Score | Smallest Sum Prob P (N) |
|---|---|---|
| patp:AAU19418 Human diagnostic and therapeutic polypeptide (DITHP) #4 | 1296 | 5.7e-132 |
| patp:AAB63110 Human secreted protein sequence encoded by gene 27 | 964 | 8.7e-97 |
| patp:AAG73863 Human colon cancer antigen protein | 872 | 4.9e-87 |
| patp:AAB59588 Human carbonic anhydrase isoform #1 | 870 | 8.0e-87 |

TABLE 7E-continued

PatP Results for NOV7

| Sequences Producing High-Scoring Segment Pairs: | High Score | Smallest Sum Prob P (N) |
|---|---|---|
| patp:AAW75702 Carbonic anhydrase II protein - Homo sapiens | 858 | 1.5e-85 |

In a BLAST search of public sequence databases, it was found, for example, that the NOV7a nucleic acid sequence of this invention has 551 of 793 bases (69%) identical to a gb:GENBANK-ID:HUMCAIX|acc:M33987.1 mRNA from Human carbonic anhydrase I (CAI) mRNA, complete cds. Further, the full amino acid sequence of the disclosed NOV7a protein of the invention has 160 of 257 amino acid residues (62%) identical to, and 197 of 257 amino acid residues (76%) similar to, the 260 amino acid residue ptnr:SWISSPROT-ACC:Q92051 protein from *Brachydanio rerio* (Zebrafish) (*Zebra danio*) (CARBONIC ANHYDRASE (EC 4.2.1.1) (CARBONATE DEHYDRATASE)).

In a similar BLAST search of public sequence databases, it was found, for example, that the NOV7b nucleic acid sequence of this invention has 549 of 789 bases (69%) identical to a gb:GENBANK-ID:HSCAIR|acc:X05014.1 mRNA from Human cDNA for carbonic anhydrase I. Further, the fall amino acid sequence of the disclosed NOV7b protein of the invention has 156 of 261 amino acid residues (59%) identical to, and 202 of 261 amino acid residues (77%) similar to, the 261 amino acid residue ptnr:pir-id: CRHU1 protein from human (carbonate dehydratase (EC 4.2.1.1) [validated]).

Additional BLAST results are shown in Table 7F.

TABLE 7F

NOV7 BLASTP Results

| Gene Index/ Identifier | Protein/Organism | Length of aa | Identity (%) | Positives (%) | Expect Value |
|---|---|---|---|---|---|
| Q9D6N1 | CARBONIC ANHYDRASE (EC 4.2.1.1) (CARBONATE DEHYDRATASE) (CARBONIC ANHYDRASE XIII) - Mus musculus (Mouse) | 262 | 238/262 (90%) | 250/262 (95%) | 1.7e−130 |
| Q92051 | Carbonic anhydrase (EC 4.2.1.1) (Carbonate dehydratase) - Brachydanio rerio (Zebrafish) (Zebra danio | 260 | 160/257 (62%) | 197/257 (76%) | 3.8e−87 |
| CRHU1 | carbonate dehydratase (EC 4.2.1.1) I [validated] - human | 261 | 157/261 (60%) | 202/261 (77%) | 6.2e−87 |
| JN0836 | carbonate dehydratase (EC 4.2.1.1) I - gorilla | 261 | 158/261 (60%) | 202/261 (77%) | 6.2e−87 |
| P00917 | Carbonic anhydrase I (EC 4.2.1.1) (Carbonate dehydratase I) (CA-I) - Equus caballus (Horse) | 260 | 160/256 (62%) | 196/256 (76%) | 1.0e−86 |

A multiple sequence alignment is given in Table 7G, with the NOV7 proteins of the invention being shown in lines 1 and 2 in a ClustalW analysis comparing NOV7 with related protein sequences of Table 7F.

Table 7G. ClustalW Analysis of NOV7

1. SEQ ID NO.: 16    NOV7a
2. SEQ ID NO.: 18    NOV7b
3. SEQ ID NO.: 162    Q9D6N1
4. SEQ ID NO.: 163    Q92051
5. SEQ ID NO.: 164    CRHU1
6. SEQ ID NO.: 165    JN0836
7. SEQ ID NO.: 166    P00917

```
              10        20        30        40        50        60
               |         |         |         |         |         |
NOV7a    MSRLSWGYREHNGPIHWKEFFPIADGDQQSPIEIKTKEVKYDSSLRPLSIKYDPSSAKII  60
NOV7b    MSRLSWGYREHNGPIHWKEFFPIADGDQQSPIEIKTKEVKYDSSLRPLSIKYDPSSAKII  60
Q9D6N1   MARLSWGYGEHNGPIHWNELFPIADGDQQSPIEIKTKEVKYDSSLRPLSIKYDPASAKII  60
Q92051   -MAHAWGYGPADGPESWAESFPIANGPRQSPIDIVPTQAQHDPSLKHLKLKYDPATTKSI  59
CRHU1    MASPDWGYDDKNGPEQWSKLYPIANGNNQSPVDIKTSETKHDTSLKPISVSYNPATAKEI  60
JN0836   MASPDWGYDDKNGPEQWSKLYPIANGNNQSPVDIKTSETKHDTSLKPISVSYNPATAKEI  60
P00917   -AHSDWGYDSPEGPZEWVKLYPIAEGEBQSPIDIKTSETKHDTSLKPFSVSYDPATAKEI  59

70        80        90       100       110       120
               |         |         |         |         |         |
NOV7a    SNSGHSFNVDFDDTENKSVLRGGPLIGSYRLRQVHLHWGSADDHGSEHIVDGVSYAAELH 120
NOV7b    SNSGHSFNVDFDDTENKSVLRGGPLIGSYRLRQVHLHWGSADDHGSEHIVDGVSYAAELH 120
Q9D6N1   SNSGHSFNVDFDDTEDKSVLRGGPLIGNYRLRQFHLHWGSADDHGSEHVVDGVRYAAELH 120
Q92051   LNNGHSFQVDFVDDLNSSTLAGGPLIGIYRLRQFHFHWGSSDDKGSEHTIAGTKFPCELH 119
CRHU1    INVGHSFHVNFEDNDNRSVLKGGPFSDSYRLFQFHFHWGSTNEHGSEHTVDGVKYSAELH 120
JN0836   INVGHSFHVTFEDNDNRSVLKGGPLSDSYRLFQFHFHWGSTNEHGSEHTVDGVKYSAELH 120
P00917   VNVGHSFQVKFEDSDNRSVLKDGPLPGSYRLVQFHFHWGSTDDYGSEHTVDGVKYSAELH 119

130       140       150       160       170       180
               |         |         |         |         |         |
NOV7a    VVHWNSDKYPSFVEAAHEPDGLAVLGVFLQVGEPNSQLQKITDTLDSIKEKGKQTRFTNF 180
NOV7b    VVHWNSDKYPSFVEAAHEPDGLAVLGVFLQIGEPNSQLQKITDTLDSIKEKGKQTRFTNF 180
Q9D6N1   VVHWNSDKYPSFVEAAHESDGLAVLGVFLQIGEHNPQLQKITDILDSIKEKGKQTRFTANF 180
Q92051   LVHWNT-KYPNFGEAASKPDGLAVVGVFLKIGAANPRLQKVLDALDDIKSKGRQTTFANF 178
CRHU1    VAHWNSAKYSSLAEAASKADGLAVIGVLMKVGEANPKLQKVLDALQAIKTKGKRAPFTNF 180
JN0836   LTHWNSAKYSSLAEAASKADGLAVIGVLMKVGEANPKLQKILDALQAIKTKGKRAPFTNF 180
P00917   LVHWNSSKYSSFDEASSQADGLAIIGVLMKVGEANPKLQKVLDALNEVKTKGKKAPFKNF 179
```

```
              190       200       210       220       230       240
               |         |         |         |         |         |
NOV7a    DLLSLLPPSWDYWTYPGSLTVPPLLESVTWIVLKQPINISSQQLAKFRSLLCTAEGEAAA 240
NOV7b    DLLSLLPPSWDYWTYPGSLTVPPLLESVTWIVLKQPINISSQQLAKFRSLLCTAEGEAAA 240
Q9D6N1   DPLCLLPSSWDYWTYPGSLTVPPLLESVTWIVLKQPISISSQQLARFRSLLCTAEGESAA 240
Q92051   DPKILLPASLDYWTYEGSLTTPPLLESVTWIVLKQPISVSPAQMAKFRSLLFSSEGETPC 238
CRHU1    DPSILLPSSLDFWTYPGSLTHPPLYESVTWIICKESISVSSEQLACFRSLLSNVEGDNAV 240
JN0836   DPSILLPSSLDFWTYPGSLTHPPLYESVTWIICKESISVSSEQLACFRSLLSNVEGDNAV 240
P00917   DPSSLLPSSPDYWTYSGSLTHPPLYESVTWIVCKENISISSQQLSCFRSLLSNVEGGKAV 239

250       260
                   |         |
NOV7a    FLVSNHRPPQPLKGRKVRASFH 262
NOV7b    FLVSNHRPPQPLKGRKVRASFH 262
Q9D6N1   FLLSNHRPPQPLKGRRVRASFY 262
Q92051   CMVDNYRPPQPLKGRKVRASFK 260
CRHU1    PMQHNNRPTQPLKGRTVRASF- 261
JN0836   PMQHNNRPTQPLKGRTVRASF- 261
P00917   PIQHNNRPPQPLKGRTVRAFF- 260
```

The presence of identifiable domains in the disclosed NOV7 protein was determined by using Pfam and then determining the Interpro number. The results are listed in Table 7H with the statistics and domain description.

TABLE 7H

Domain Analysis of NOV7

| PSSMs Producing Significant Alignments | Score (bits) | E Value |
|---|---|---|
| carb_anhydrase: domain 1 of 1, from 6 to 261 | 551.1 | 7.4e-162 |

```
Carb. Anhy.    WgYgehngpehsnnahvlWhklyPiAnGGnCqGerQSPInIqtkeak
               |+|  +++++ +         | +++|+|        |+ ||||+|++++++
NOV7           WGYREHNGPIH-------WKEFFPIAD-----GDQQSPIEIKTKEVK Carb. Anhy.    yDPsLkpLslSYdaatakefeivNnGHsfqVeFdDsddksvlsGGPLpaG
               +| +|++|++ |++ +++   + |  |||+++|+|+|+ ++++++|||| ++
NOV7           YDSSLRPLSIKYDPSSAK--IISNSGHSFNVDFDDTENKSVLRGGPLTG- Carb. Anhy.    hpYRLkQfHFHWGGAssddqGSEHTVDGkkYaaELHLVHWNstKYgsyke
                +|||+|+|+|||  + +++||||  |||++|++|||+||||+ || ++ +
NOV7           -SYRLRQVHLHWG--SADDHGSEHIVDGVSYAAELHVVHWNSDKYPSFVE Carb. Anhy.    AvskpDGLAVlGvFlkvGdyqenpglqkvvDaLssIktKGksatftnFDP
               |+ ++||||||+|+|+++|  + +  +++ +|  |++|+ ||+++ +++||+
NOV7           AAHEPDGLAVLGVFLQVG--EPNSQLQKITDTLDSIKEKGKQTRFTNFDL Carb. Anhy.    stLLPseklrDYWTYpGSLTTPPLtEsVtWiVlkepIsvSseQllkFRsL
               +|||+  ++|||||+||||  ||| |+|+|+|++ +|  +|++|+++||+|
NOV7           LSLLPP--SWDYWTYPGSLTVPPLLESVTWIVLKQPINISSQQLAKFRSL lfnaegeeevpGCdGimvdNyRPtQPLkgRvVrASF    (SEQ ID NO:167)
               + +++++ +         ++ |+||+||||++|+|+|||
NOV7           LCTAEGEAAAF-----LVSNHRPPQPLKGRKVRASF    (SEQ ID NO:16)
```

Consistent with other known members of the carbonate dehydratase family of proteins, NOV7 contains carbonic anhydrase domains as illustrated in Table 7H.

NOV7 nucleic acids, and the encoded polypeptides, according to the invention are useful in a variety of applications and contexts. For example, NOV7 nucleic acids and polypeptides can be used to identify proteins that are members of the carbonate dehydratase family of proteins. The NOV7 nucleic acids and polypeptides can also be used to screen for molecules, which inhibit or enhance NOV7 activity or function. Specifically, the nucleic acids and polypeptides according to the invention may be used as targets for the identification of small molecules that modulate or inhibit, e.g., a variety of biological processes such as respiration, calcification, acid-base balance, bone resorption and the formation of aqueous humor, cerebrospinal fluid, saliva, and gastric acid. These molecules can be used to treat, e.g., hypertension, asthma, or emphysema.

In addition, various NOV7 nucleic acids and polypeptides according to the invention are useful, inter alia, as novel members of the protein families according to the presence of domains and sequence relatedness to previously described proteins. For example, the NOV7 nucleic acids and their encoded polypeptides include structural motifs that are characteristic of proteins belonging to the lyase family such as the carbonic dehydratase protein. Carbonic dehydratase is an enzyme that catalyzes the equilibration of dissolved carbon dioxide and carbonic acid, speeding the movement of carbon dioxide from tissues to blood to alveolar air. It is a zinc metalloenzyme of great physiological importance.

The NOV7 nucleic acids and polypeptides, antibodies and related compounds according to the invention will be useful in therapeutic and diagnostic applications in the mediation of CO2 transport. As such the NOV7 nucleic acids and polypeptides, antibodies and related compounds according to the invention may be used to treat respiratory or CO2 transport disorders, e.g., lung cancer, hypertension, asthma, emphysema, or diabetes.

The NOV7 nucleic acids and polypeptides are useful for detecting specific cell types. For example, expression analysis has demonstrated that a NOV7 nucleic acid is expressed in lung.

Additional utilities for NOV7 nucleic acids and polypeptides according to the invention are disclosed herein.

NOV8

The NOV8 proteins descibed herein are novel carboxypeptidase-like proteins. The NOV8 nucleic acids disclosed herein map to chromosome 2. Four alternative novel NOV8 nucleic acids and polypeptides are disclosed herein, namely NOV8a, NOV8b, NOV8c and NOV8d.

NOV8a

A NOV8 variant is NOV8a (alternatively referred to herein as CG55794-01), which encodes the 1196 nucleotide sequence (SEQ ID NO:19) shown in Table 8A. An open reading frame for the mature protein was identified beginning with an ATG codon at nucleotides 16–18 and ending with a TAA codon at nucleotides 1138–1140. Putative untranslated regions, if any, downstream from the termination codon and upstream from the initiation codon are underlined. The start and stop codons are in bold letters.

TABLE 8A

NOV8a Nucleotide Sequence (SEQ ID NO:19)

TTACTGTGTGGCAGAATGAAGCCTCTGCTTGAAACCCTTTATCTTTTGGGGATGCTGGTTCCTGGAGGGCTGGGA

TATGATAGATCCTTAGCCCAACACAGACAAGAGATTGTGGACAAGTCAGTGAGTCCATGGAGCCTGGAGACGTAT

TCCTATAACATATACCACCCCATGGGAGAGATCAATGAGTGGATGAGAGAGATCAGTGAGAAGTACAAGGAAGTG

GTGACACAGCATTTCCTAGGAGTGACCTATGAGACCCACCCCATATATTATCTGAAGATCAGCCAACCATCTGGT

AATCCCAAGAAAATCATTTGGATGGGCTGTGGAATTCACGCCAGAGAATGGATTGCTCCTGCTTTTTGCCAATGG

TTCGTCAAAGAAATTCTACAAAACCATAAAGACAACTCAAGGATACGCAAGCTCCTTAGGAACCTGGACTTCTAT

GTCCTTCCAGTTCTTAACATAGATGGTTATATCTACACTTGGACAACTGATCGTCTTTGGAGGAAATCCCGTTCA

CCCCATAATAATGGCACATGTTTTGGGACGGATCTCAATCGAAATTTCAATGCATCTTGGTGTAGTATTGGTGCC

TCTAGAAACTGCCAAGATCAAACATTCTGTGGGACAGGGCCAGTGTCTGAACCAGAGACTAAAGCTGTTGCCAGC

TTCATAGAGAGCAAGAAGGATGATATTTTGTGCTTCCTGACCATGCACTCTTATGGGCAGTTAATTCTCACACCT

TACGGCTACACCAAAAATAAATCAAGTAACCACCCAGAAATGATTCAAGTTGGACAGAAGGCAGCAAATGCATTG

AAAGCAAAGTATGGAACCAATTATAGAGTTGGATCGAGTGCAGATATTTTATATGCCTCATCAGGGTCTTCAAGA

GATTGGGCCCGAGACATTGGGATTCCCTTCTCATATACGTTTGAGCTGAGGGACAGTGGAACATATGGGTTTGTT

CTGCCAGAAGCTCAGATCCAGCCCACCTGTGAGGAGACCATGGAGGCTGTGCTGTCAGTCCTGGATGATGTGTAT

GCGAAACACTGGCACTCGGACAGTGCTGGAAGGGTGACATCTGCCACTATGCTGCTGGGCCTGCTGGTGTCCTGC

ATGTCTCTTCTCTAAGTGCATCCTGCCCAGGCCTGCTCAACCCCAGTGGCATGAGTGTGGCTGGAGGCG

The NOV8a protein (SEQ ID NO:20) encoded by SEQ ID NO:19 is 374 amino acid residues in length and is presented using the one-letter amino acid code in Table 8B. The SignalP, Psort and/or Hydropathy results indicate that NOV8a has a signal peptide and is likely to be localized extracellularly at the plasma membrane with a certainty of 0.9190. Alternatively, a NOV8a polypeptide is located to the lysosome (membrane) with a certainty of 0.2000, the microbody (peroxisome) with a certainty of 0.1292, or the endoplasmic reticulum (membrane) with a certainty of 0.1000. The SignalP indicates a likely cleavage site for a NOV8a peptide is between positions 20 and 21, i.e., at the dash in the sequence GLG-YD.

SNP variants of NOV8a are disclosed in Example 2.

NOV8b

Alternatively, a NOV8 variant is NOV8b (alternatively referred to herein as CG5579403), which includes the 1222 nucleotide sequence (SEQ ID NO:21) shown in Table 8C. An open reading frame for the mature protein was identified beginning with an ATG codon at nucleotides 41–43 and ending with a TAA codon at nucleotides 1163–1165. Putative untranslated regions, if any, downstream from the termination codon and upstream from the initiation codon are underlined. The start and stop codons are in bold letters.

TABLE 8B

Encoded NOV8a Protein Sequence (SEQ ID NO:20)

MKPLLETLYLLGMLVPGGLGYDRSLAQHRQEIVDKSVSPWSLETYSYNIYHPMGEINEWMREISEKYKEVVTQHF

LGVTYETHPIYYLKISQPSGNPKKIIWMGCGIHAREWIAPAFCQWFVKEILQNHKDNSRIRKLLRNLDFYVLPVL

NIDGYIYTWTTDRLWRKSRSPHNNGTCFGTDLNRNFNASWCSIGASRNCQDQTFCGTGPVSEPETKAVASFIESK

KDDILCFLTMHSYGQLILTPYGYTKNKSSNHPEMIQVGQKAANALKAKYGTNYRVGSSADILYASSGSSRDWARD

IGIPFSYTFELRDSGTYGFVLPEAQIQPTCEETMEAVLSVLDDVYAKHWHSDSAGRVTSATMLLGLLVSCMSLL

TABLE 8C

NOV8b Nucleotide Sequence (SEQ ID NO:21)

CCAGAGAGGCCCAGAATTTTCTAACTTACTGTGTGGCAGAATGAAGCCTCTGCTTGAAACCCTTTATCTTTTGGG

GATGCTGGTTCCTGGAGGGCTGGGATATGATAGATCCTTAGCCCAACACAGACAAGAGATTGTGGACAAGTCAGT

GAGTCCATGGAGCCTGGAGACGTATTCCTATAACATATACCACCCCATGGGAGAGATCTATGAGTGGATGAGAGA

GATCAGTGAGAAGTACAAGGAAGTGGTGACACAGCATTTCCTAGGAGTGACCTATGAGACCCACCCCATATATTA

TCTGAAGATCAGCCAACCATCTGGTAATCCCAAGAAAATCATTTGGATGGACTGTGGAATTCACGCCAGAGAATG

GATTGCTCCTGCTTTTTGCCAATGGTTCGTCAAAGAAATTCTACAAAACCATAAAGACAACTCAAGGATACGCAA

GCTCCTTAGGAACCTGGACTTCTATGTCCTTCCAGTTCTTAACATAGATGGTTATATCTACACTTGGACAACTGA

TCGTCTTTGGAGGAAATCCCGTTCACCCCATAATAATGGCACATGTTTTGGGACGGATCTCAATCGAAATTTCAA

TGCTTCTTGGTGTAGTATTGGTGCCTCTAGAAACTGCCAAGATCAAACATTCTGTGGGACAGGGCCAGTGTCTGA

ACCAGAGACTAAAGCTGTTGCCAGCTTCATAGAGAGCAAGAAGGATGATATTTTGTGCTTCCTGACCATGCACTC

TTATGGGCAGTTAATTCTCACACCTTACGGCTACACCAAAAATAAATCAAGTAACCACCCAGAAATGATTCAAGT

TGGACAGAAGGCAGCAAATGCATTGAAAGCAAAGTATGGAACCAATTATAGAGTTGGATCGAGTGCAGATATTTT

ATATGCCTCATCAGGGTCTTCAAGAGATTGGGCCCGAGACATTGGGATTCCCTTCTCATATACGTTTGAGCTGAG

GGACAGTGGAACATATGGGTTTGTTCTGCCAGAAGCTCAGATCCAGCCCACCTGTGAGGAGACCATGGAGGCTGT

GCTGTCAGTCCTGGATGATGTGTATGCGAAACACTGGCACTCGGACAGTGCTGGAAGGGTGACATCTGCCACTAT

GCTGCTGGGCCTGCTGGTGTCCTGCATGTCTCTTCTTAAGTGCATTCTGCCCAGGCCTGCTCAACCCCAGTGGC

ATGAGTGTGGCTTGGAGGAACG

The NOV8b protein (SEQ ID NO:22) encoded by SEQ ID NO:21 is 347 amino acid residues in length and is presented using the one-letter amino acid code in Table 8D. The SignalP, Psort and/or Hydropathy results indicate that NOV8b has a signal peptide and is likely to be localized extracellularly at the plasma membrane with a certainty of 0.9190. Alternatively, a NOV8b polypeptide is located to the lysosome (membrane) with a certainty of 0.2000, the microbody (peroxisome) with a certainty of 0.1345, or the endoplasmic reticulum (membrane) with a certainty of 0.1000. The SignalP indicates a likely cleavage site for a NOV8b peptide is between positions 20 and 21, i.e., at the dash in the sequence GLG-YD.

NOV8c

Alternatively, a NOV8 variant is NOV8c (alternatively referred to herein as CG55794-06), which includes the 977 nucleotide sequence (SEQ ID NO:23) shown in Table 8E. An open reading frame for the mature protein was identified beginning with an ATG codon at nucleotides 41–43 and ending with a TAG codon at nucleotides 671–673. Putative untranslated regions, if any, downstream from the termination codon and upstream from the initiation codon are underlined. The start and stop codons are in bold letters.

TABLE 8D

Encoded NOV8b Protein Sequence (SEQ ID NO:22)

MKPLLETLYLLGMLVPGGLGYDRSLAQHRQEIVDKSVSPWSLETYSYNIYHPMGEIYEWMREISEKYKEVVTQHF

LGVTYETHPIYYLKISQPSGNPKKIIWMDCGIHAREWIAPAFCQWFVKEILQNHKDNSRIRKLLRNLDFYVLPVL

NIDGYIYTWTTDRLWRKSRSPHNNGTCFGTDLNRNFNASWCSIGASRNCQDQTFCGTGPVSEPETKAVASFIESK

KDDILCFLTMHSYGQLILTPYGYTKNKSSNHPEMIQVGQKAANALKAKYGTNYRVGSSADILYASSGSSRDWARD

IGIPFSYTFELRDSGTYGFVLPEAQIQPTCEETMEAVLSVLDDVYAKHWHSDSAGRVTSATMLLGLLVSCMSLL

TABLE 8E

NOV8c Nucleotide Sequence (SEQ ID NO:23)

CCAGAGAGGCCCAGAATTTTCTAACTTACTGTGTGGCAGAATGAAGCCTCTGCTTGAAACCCTTTATCTTTTGGG

GATGCTGGTTCCTGGAGGGCTGGGATATGATAGATCCTTAGCCCAACACAGACAAGAGATTGTGGACAAGTCAGT

GAGTCCATGGAGCCTGGAAACGTATTCCTATAACATATACCACCCCATGGGAGAGATCTATGAGTGGATGAGAGA

GATCAGTGAGAAGTACAAGGAAGTGGTGACACAGCATTTCCTAGGAGTGACCTATGAGACCCACCCCATATATTA

TCTGAAGATCAGCCAACCATCTGGTAATCCCAAGAAAATCATTTGGATGGACTGTGGAATTCACGCCAGAGAATG

GATTGCTCCTGCTTTTTGCCAATGGTTCGTCAAAGAAATTCTACAAAACCATAAAGACAACTCAAGGATACGCAA

GCTCCTTAGGAACCTGGACTTCTATGTCCTTCCAGTTCTTAACATAGATGGTTATATCTACACTTGGACAACTGA

TCGTCTTTGGAGGAAATCCCGTTCACCCCATAATAATGGCACATGTTTGGGACGGATCTCAATCGAAATTTCAA

TGCTTCTTGGTGTAATTCAAGTTGGACAGAAGGCAGCAAATGCATTGAAAGCAAAGTATGGAACCAATTATAGAG

TTGGATCGAGTGCAGATATTTTATATGCCTCATCAGGGTCTTCAAGAGATTGGGCCCGAGACATTGGGATTCCCT

TCTCATATACGTTTGAGCTGAGGGACAGTGGAACATATGGGTTTGTTCTGCCAGAAGCTCAGATCCAGCCCACCT

GTGAGGAGACCATGGAGGCTGTGCTGTCAGTCCTGGATGATGTGTATGCGAAACACTGGCACTCGGACAGTGCTG

GAAGGGTGACATCTGCCACTATGCTGCTGGGCCTGCTGGTGTCCTGCATGTCTCTTCTCTAAGTGCATCCTGCCC

AG

The NOV8c protein (SEQ ID NO:24) encoded by SEQ ID NO:23 is 210 amino acid residues in length and is presented using the one-letter amino acid code in Table 8F. The SignalP, Psort and/or Hydropathy results indicate that NOV8c has a signal peptide and is likely to be localized extracellularly at the plasma membrane with a certainty of 0.3700. Alternatively, a NOV8c polypeptide is located to the microbody (peroxisome) with a certainty of 0.2242, the lysosome (lumen) with a certainty of 0.1900, or the endoplasmic reticulum (membrane) with a certainty of 0.1000. The SignalP indicates a likely cleavage site for a NOV8c peptide is between positions 20 and 21, i.e., at the dash in the sequence GLG-YD.

NOV8d

Alternatively, a NOV8 variant is NOV8d (alternatively referred to herein as CG55794-07), which includes the 1378 nucleotide sequence (SEQ ID NO:25) shown in Table 8G. An open reading frame for the mature protein was identified beginning with an ATG codon at nucleotides 259–261 and ending with a TAA codon at nucleotides 1225–1227. Putative untranslated regions, if any, downstream from the termination codon and upstream from the initiation codon are underlined. The start and stop codons are in bold letters.

TABLE 8F

Encoded NOV8c Protein Sequence (SEQ ID NO:24)

MKPLLETLYLLGMLVPGGLGYDRSLAQHRQEIVDKSVSPWSLETYSYNIYHPMGEIYEWMREISEKYKEVVTQHF

LGVTYETHPIYYLKISQPSGNPKKIIWMDCGIHAREWIAPAFCQWFVKEILQNHKDNSRIRKLLPNLDFYVLPVL

NIDGYIYTWTTDRLWRKSRSPHNNGTCFGTDLNRNFNASWCNSSWTEGSKCIESKVWNQL

TABLE 8G

NOV8d Nucleotide Sequence (SEQ ID NO:25)

ACTCACTATAGGGCTCGAGCGGCCGCCCGGGCAGGTGAAAATACATCAGCATGTGGGAAAGAGCAACGTTGATCG

TCTTCACGGAAAGGCTGAGGACCCTGCGCCTACCACATGTTGGCCAGGGTGAGCAAGCAGTGAAAGAGAAAACAC

TTTTTTCAAAAAGCCAACTGATCCTTAGCCCAACACAGACAAGAGATTGTGGACAAGTCAGTGAGTCCATGGAGC

CTGGAGACGTATTCCTATAACATATACCACCCCATGGGAGAGATCTATGAGTGGATGAGAGAGATCAGTGAGAAG

TACAAGGAAGTGGTGACACAGCATTTCCTAGGAGTGACCTATGAGACCCACCCCATATATTATCTGAAGATCAGC

CAACCATCTGGTAATCCCAAGAAAATCATTTGGATGGACTGTGGAATTCACGCCAGAGAATGGATTGCTCCTGCT

TTTTGCCAATGGTTCGTCAAAGAAATTCTACAAAACCATAAAGACAACTCAAGGATACGCAAGCTCCTTAGGAAC

CTGGACTTCTATGTCCTTCCAGTTCTTAACATAGATGGTTATATCTACACTTGGACAACTGATCGTCTTTGGAGG

AAATCCCGTTCACCCCATAATAATGGCACATGTTTTGGGACGGATCTCAATCGAAATTTCAATGCTTCTTGGTGT

AGTATTGGTGCCTCTAGAAACTGCCAAGATCAAACATTCTGTGGGACAGGGCCAGTGTCTGAACCAGAGACTAAA

GCTGTTGCCAGCTTCATAGAGAGCAAGAAGGATGATATTTTGTGCTTCCTGACCATGCACTCTTATGGGCAGTTA

ATTCTCACACCTTACGGCTACACCAAAAATAAATCAAGTAACCACCCAGAAATGATTCAAGTTGGACAGAAGGCA

GCAAATGCATTGAAAGCAAAGTATGGAACCAATTATAGAGTTGGATCGAGTGCAGATATTTTATATGCCTCATCA

GGGTCTTCAAGAGATTGGGCCCGAGACATTGGGATTCCCTTCTCATATACGTTTGAGCTGAGGGACAGTGGAACA

TATGGGTTTGTTCTGCCAGAAGCTCAGATCCAGCCCACCTGTGAGGAGACCATGGAGGCTGTGCTGTCAGTCCTG

GATGATGTGTATGCGAAACACTGGCACTCGGACAGTGCTGGAAGGGTGACATCTGCCACTATGCTGCTGGGCCTG

CTGGTGTCCTGCATGTCTCTTCTCTAAGTGCATTCTGCCCAGGCCTGCTCAACCCCAGTGGCATGAGTGTGGCTG

GAGGAACGGTGTGTTATGGTTGTAAAGAAACCAAATAATTTAACTAAAAATACTTCCTATTTCAATAAAAAAAAA

AAAAAAAAAAAAAAAAAAAAAAAAAAA

The NOV8d protein (SEQ ID NO:26) encoded by SEQ ID NO:25 is 322 amino acid residues in length and is presented using the one-letter amino acid code in Table 8H. The SignalP, Psort and/or Hydropathy results indicate that NOV8d has no known signal peptide and is likely to be localized in the cytoplasm at the endoplasmic reticulum (membrane) with a certainty of 0.8500. Alternatively, a NOV8d polypeptide is located to the microbody (peroxisome) with a certainty of 0.4781, the plasma membrane with a certainty of 0.4400, or the mitochondrial inner membrane with a certainty of 0.1000.

NOV8 Clones

Unless specifically addressed as NOV8a, NOV8b, NOV8c, or NOV8d any reference to NOV8 is assumed to encompass all variants.

A search against the Patp database, a proprietary database that contains sequences published in patents and patent publication, yielded several homologous proteins shown in Table 8I

TABLE 8H

Encoded NOV8d Protein Sequence (SEQ ID NO:26)

MGEIYEWMREISEKYKEVVTQHFLGVTYETHPIYYLKISQPSGNPKKIIWMDCGIHAREWIAPAFCQWFVKEILQ

NHKDNSRIRKLLRNLDFYVLPVLNIDGYIYTWTTDRLWRKSRSPHNNGTCFGTDLNRNFNASWCSIGASRNCQDQ

TFCGTGPVSEPETKAVASFIESKKDDILCFLTMHSYGQLILTPYGYTKNKSSNHPEMIQVGQKAANALKAKYGTN

YRVGSSADILYASSGSSRDWARDIGIPFSYTFELRDSGTYGFVLPEAQIQPTCEETMEAVLSVLDDVYAKHWHSD

SAGRVTSATMLLGLLVSCMSLL

TABLE 8I

PatP Results for NOV8

| Sequences Producing High-Scoring Segment Pairs: | High Score | Smallest Sum Prob P (N) |
|---|---|---|
| patp:AAG66547 Human secreted metallocarboxy-peptidase-like polypeptide | 2001 | 1.1e−206 |
| patp:AAG66565 Human secreted metallocarboxy-peptidase-like variant polypeptide | 1998 | 2.3e−206 |
| patp:AAB74682 Human protease and protease inhibitor PPIM-15 | 1932 | 2.3e−199 |
| patp:AAG66560 Human secreted metallocarboxy-peptidase-like polypeptide | 1899 | 7.3e−196 |
| patp:AAG66566 Human secreted metallocarboxy-peptidase-like polypeptide | 1896 | 1.5e−195 |

In a BLAST search of public sequence databases, it was found, for example, that the NOV8a nucleic acid sequence of this invention has 584 of 914 bases (63%) identical to a gb:GENBANK-ID:AF190274|acc:AF190274.1 mRNA from Bothrops jararaca (Bothrops jararaca carboxypeptidase homolog mRNA, complete cds). Further, the full amino acid sequence of the disclosed NOV8a protein of the invention has 151 of 325 amino acid residues (46%) identical to, and 219 of 325 amino acid residues (67%) similar to, the 416 amino acid residue ptnr:SPTREMBL-ACC:Q9PUF2 protein from Bothrops jararaca (Jararaca) (CARBOXYPEPTIDASE HOMOLOG).

In a similar BLAST search of public sequence databases, it was found, for example, that the NOV8b nucleic acid sequence of this invention has 586 of 914 bases (64%) identical to a gb:GENBANK-ID:AF190274|acc:AF190274.1 mRNA from Bothrops jararaca (Bothrops jararaca carboxypeptidase homolog mRNA, complete cds). Further, the full amino acid sequence of the disclosed NOV8b protein of the invention has 152 of 325 amino acid residues (46%) identical to, and 219 of 325 amino acid residues (67%) similar to, the 416 amino acid residue ptnr:SP-TREMBL-ACC:Q9PUF2 protein from Bothrops jararaca (Jararaca) (CARBOXYPEPTIDASE HOMOLOG).

In a further BLAST search of public sequence databases, it was found, for example, that the NOV8c nucleic acid sequence of this invention has 621 of 672 bases (92%) identical to a gb:GENBANK-ID:AX083139|acc:AX083139.1 mRNA from Homo sapiens (Sequence 42 from Patent WO0110903). Further, the full amino acid sequence of the disclosed NOV8d protein of the invention has 83 of 176 amino acid residues (47%) identical to, and 122 of 176 amino acid residues (69%) similar to, the 422 amino acid residue ptnr:SPTREMBL-ACC:Q9EQV9 protein from Rattus norvegicus (Rat) (PRE-PROCARBOXYPEPTIDASE R).

In yet a further BLAST search of public sequence databases, it was found, for example, that the NOV8d nucleic acid sequence of this invention has 1073 of 1077 bases (99%) identical to a gb:GENBANK-ID:AX083139|acc:AX083139.1 mRNA from Homo sapiens (Sequence 42 from Patent WO0110903). Further, the full amino acid sequence of the disclosed NOV8d protein of the invention has 142 of 283 amino acid residues (50%) identical to, and 199 of 283 amino acid residues (70%) similar to, the 416 amino acid residue ptnr:SPTREMBL-ACC:Q9PUF2 protein from Bothrops jararaca (Jararaca) (CARBOXYPEPTIDASE HOMOLOG).

Additional BLAST results are shown in Table 8J.

TABLE 8J

NOV8 BLASTP Results

| Gene Index/ Identifier | Protein/Organism | Length of aa | Identity (%) | Positives (%) | Expect Value |
|---|---|---|---|---|---|
| Q9PUF2 | CARBOXYPEPTIDASE HOMOLOG - Bothrops jararaca (Jararaca) | 416 | 151/325 (46%) | 219/325 (67%) | 9.7e−82 |
| CAA03381 | SEQUENCE 85 FROM PATENT WO9620011 - unidentified | 349 | 149/311 (47%) | 204/311 (65%) | 7.9e−80 |
| CAA03380 | SEQUENCE 81 FROM PATENT WO9620011 - unidentified | 349 | 148/311 (47%) | 204/311 (65%) | 1.6e−79 |
| CAA03377 | SEQUENCE 68 FROM PATENT WO9620011 - unidentified | 349 | 148/311 (47%) | 203/311 (65%) | 4.3e−79 |
| Q9JHH6 | CARBOXYPEPTIDASE R (THROMBIN-ACTIVATABLE FIBRINOLYSIS INHIBITOR) (1110032P04RIK PROTEIN) - Mus musculus (Mouse) | 422 | 141/313 (45%) | 206/313 (65%) | 7.1e−79 |

A multiple sequence alignment is given in Table 8K, with the NOV8 proteins of the invention being shown in lines 1 through 4 in a ClustalW analysis comparing NOV8 with related protein sequences of Table 8J.

Table 8K. ClustalW Analysis of NOV8

1. SEQ ID NO.: 20     NOV8a
2. SEQ ID NO.: 22     NOV8b
3. SEQ ID NO.: 24     NOV8c
4. SEQ ID NO.: 26     NOV8d
5. SEQ ID NO.: 168     Q9PUF2
6. SEQ ID NO.: 169     CAA03381
7. SEQ ID NO.: 170     CAA03380
8. SEQ ID NO.: 171     CAA03377
9. SEQ ID NO.: 172     Q9JHH6

125                                  126

```
                 10        20        30        40        50        60
            ....|....|....|....|....|....|....|....|....|....|....|....|
NOV8a       ------------------------------------------------------------   1
NOV8b       ------------------------------------------------------------   1
NOV8c       ------------------------------------------------------------   1
NOV8d       ------------------------------------------------------------   1
Q9PUF2      MWPLLFLIGATSAFAETTVHRFDGEKVYRVTPRNEDEVYFLNYLANIVQVDFWRPDSVEL  60
CAA03381    ------------------------------------------------------------   1
CAA03380    ------------------------------------------------------------   1
CAA03377    ------------------------------------------------------------   1
Q9JHH6      MKLHGLGILVAIILYEQHGFAFQSGQVLSALPRTSRQVQLLQNLTTTYEVVLWQPVTAEF  60

70        80        90       100       110       120
            ....|....|....|....|....|....|....|....|....|....|....|....|
NOV8a       MKPLLET-LY-------LLGMLVPGGLGYDRSLAQHRQEIVDKSVSPWS----LETYSY   47
NOV8b       MKPLLET-LY-------LLGMLVPGGLGYDRSLAQHRQEIVDKSVSPWS----LETYSY   47
NOV8c       MKPLLET-LY-------LLGMLVPGGLGYDRSLAQHRQEIVDKSVSPWS----LETYSY   47
NOV8d       ------------------------------------------------------------   1
Q9PUF2      VKAEMTVDFRIEADRCSEVESILQQSGLNYE-ILIDNLQAVLDRQLD---NHARTAGYNY 116
CAA03381    -----------------MKYLLPTAAAG---LLLLAAQPAMA----------ATGHSY   28
CAA03380    -----------------MKYLLPTAAAG---LLLLAAQPAMA----------ATGHSY   28
CAA03377    -----------------MKYLLPTAAAG---LLLLAAQPAMA----------ATGHSY   28
Q9JHH6      IEKKKEVHFFVNASDVDSVKAHLNVSRIPFN-VLMNNVEDLIEQQTFNDTVSPRASASYY 119

130       140       150       160       170       180
            ....|....|....|....|....|....|....|....|....|....|....|....|
NOV8a       NIYHPMGEINEWMREISEKYKEVVTQHFLGVTYETHPIYYLKISQPSGNPKKIWMGCGI 107
NOV8b       NIYHPMGEIYEWMREISEKYKEVVTQHFLGVTYETHPIYYLKISQPSGNPKKIWMDCGI 107
NOV8c       NIYHPMGEIYEWMREISEKYKEVVTQHFLGVTYETHPIYYLKISQPSGNPKKIWMDCGI 107
NOV8d       -----MGEIYEWMREISEKYKEVVTQHFLGVTYETHPIYYLKISQPSGNPKKIWMDCGI  55
Q9PUF2      EKYNSWEKIDAWTADIANENPSLVSRLQIGTTFEGRPMPLLKV-GKPGVNKKAIFIDCGF 175
CAA03381    EKYNKWETIEAWTQQVATENPALISRSVIGTTFEGRAIYLLKV-GKAGQNKPAIFMDCGF  87
CAA03380    EKYNKWETIEAWTQQVATENPALISRSVIGTTFEGRAIYLLKV-GKAGQNKPAIFMDCGF  87
CAA03377    EKYNKWETIEAWTQQVATENPALISRSVIGTTFEGRAIYLLKV-GKAGQNKPAIFMDCGF  87
Q9JHH6      EQYHSLNEIYSWIEVITEQHPDMLQKIYIGSSFEKYPIYVLKVSGKEQRIKNAIWIDCGI 179

190       200       210       220       230       240
            ....|....|....|....|....|....|....|....|....|....|....|....|
NOV8a       HAREWIAPAFCQWFVKEILQNHKDNSRIRKLLRNLDFYVLPVLNIDGYIYTWTTDRLWRK 167
NOV8b       HAREWIAPAFCQWFVKEILQNHKDNSRIRKLLRNLDFYVLPVLNIDGYIYTWTTDRLWRK 167
NOV8c       HAREWIAPAFCQWFVKEILQNHKDNSRIRKLLRNLDFYVLPVLNIDGYIYTWTTDRLWRK 167
NOV8d       HAREWIAPAFCQWFVKEILQNHKDNSRIRKLLRNLDFYVLPVLNIDGYIYTWTTDRLWRK 115
Q9PUF2      HAREWISPAFCQWFVREAVRTYGKETIMTCLLNKLDFYILPVLNIDGYVYSWKQSRMWRK 235
CAA03381    HAREWISPAFCQWFVREAVRTYGREIQVTELLDKLDFYVLPVLNIDGYIYTWTKSRFWRK 147
CAA03380    HAREWISPAFCQWFVREAVRTYGREIQVTELLDKLDFYVLPVLNIDGYIYTWTKSRFWRK 147
CAA03377    HAREWISPAFCQWFVREAVRTYGREIQVTELLDKLDFYVLPVLNIDGYIYTWTKSRFWRK 147
Q9JHH6      HAREWISPAFCLWFIGYVTQFHGKENLYTRLLRHVDFYIMPVMNVDGYDYTWKKNRMWRK 239

250       260       270       280       290       300
            ....|....|....|....|....|....|....|....|....|....|....|....|
NOV8a       SRSPHNNGTCFGTDLNRNFNAS-WCSIGASRNCQDQTICGTGPVSEPETKAVASFIESKK 226
NOV8b       SRSPHNNGTCFGTDLNRNFNAS-WCSIGASRNCQDQTICGTGPVSEPETKAVASFIESKK 226
NOV8c       SRSPHNNGTCFGTDLNRNFNAS-WCNSSWIE--------GS----K--------CIESK- 205
NOV8d       SRSPHNNGTCFGTDLNRNFNAS-WCSIGASRNCQDQTICGTGPVSEPETKAVASFIESKK 174
Q9PUF2      TRSVNAGSTCIGTDPNRNFDAA-WCSVGASRNPCSETICGSKPESEKETKALADFIRRNR 294
CAA03381    TRSTHTGSSCIGTDPNRNFDAG-WCEIGASRNPCDETICGPAAESEKETKALADFIRNKL 206
CAA03380    TRSTHTGSSCIGTDPNRNFDAG-WCEIGASRNPCDETICGPAAESEKETKALADFIRNKL 206
```

```
CAA03377  TRSIHTGSSCIGTDPNRNFDAG-WCEIGASRNPCDETVCGPAAESEKETKALADFIRNKL  206
Q9JHH6    NRSAHKNNRCVGTDLNRNFASKHWCEKGASSSSCSETVCGLYPESEPEVKAVADFLRRNI  299

310       320       330       340       350       360
                 ....|....|....|....|....|....|....|....|....|....|....|....|
NOV8a     DDILCFLTMHSYGQLILTPYGYTKNKSSNHPEMIQVGQKAANALKAKYG-TNYRVGSSAD  285
NOV8b     DDILCFLTMHSYGQLILTPYGYTKNKSSNHPEMIQVGQKAANALKAKYG-TNYRVGSSAD  285
NOV8c     --------WN-QL-----------------------------------------------  210
NOV8d     DDILCFLTMHSYGQLILTPYGYTKNKSSNHPEMIQVGQKAANALKAKYG-TNYRVGSSAD  233
Q9PUF2    SIIQAYLTIHSYSQMLLYPYSYTYDLTSNNKKLNSIAKEAIRELKVLFG-TEYTYGPGAA  353
CAA03381  SSIKAYLTIHSYSQMMIYPYSYAYKLGENNAELNALAKATVKELASLHG-TKYTYGPGAT  265
CAA03380  SSIKAYLTIHSYSQMMIYPYSYAYKLGENNAELNALAKATVKELASLHG-TKYTYGPGAT  265
CAA03377  SSIKAYLTIHSYSQMMIYPYSYAYKLGENNAELNALAKATVKELASLHG-TKYTYGPGAT  265
Q9JHH6    DHIKAYTSMHSYSQQTLFPYSYNRSKSKDHEELSLVASEAVRAIESINKNTRYTHGSGSE  359

370       380       390       400       410       420
                 ....|....|....|....|....|....|....|....|....|....|....|....|
NOV8a     ILYASSGSSRDWARDIGIPFSYTFELRDSGTYGFVLPEAQIQPTCEETMEAVLSVLDDVY  345
NOV8b     ILYASSGSSRDWARDIGIPFSYTFELRDSGTYGFVLPEAQIQPTCEETMEAVLSVLDDVY  345
NOV8c     ------------------------------------------------------------  210
NOV8d     ILYASSGSSRDWARDIGIPFSYTFELRDSGTYGFVLPEAQIQPTCEETMEAVLSVLDDVY  293
Q9PUF2    TIYPAAGGSDDWAYDQGIKYAFTFELRDKGRYGFALPESQIKPTCEETMIAVKYLAEYML  413
CAA03381  TIYPAAGGSRDWAYDQGIRYSFTFELRDIGRYGFLLPESQIRATCEETFLAIKYVASYVL  325
CAA03380  TIYPAAGGSKDWAYDQGIRYSFTFELRDIGRYGFLLPESQIRATCEETFLAIKYVASYVL  325
CAA03377  TIYPAAGGSDDWAYDQGIRYSFTFELRDIGRYGFLLPESQIRATCEETFLAIKYVASYVL  325
Q9JHH6    SLYLAPGGSDDWIYDLGIKYSFTIELRDIGRYGFLLPERYIKPTCAEALAAISKIVWHVI  419

430       440
                 ....|....|....|....|....
NOV8a     AKHWHSDSAGRVTSATMLLGLLVSCMSLL  374
NOV8b     AKHWHSDSAGRVTSATMLLGLLVSCMSLL  374
NOV8c     -----------------------------  210
NOV8d     AKHWHSDSAGRVTSATMLLGLLVSCMSLL  322
Q9PUF2    S-LY-------------------------  416
CAA03381  EHLYHHHHHHEFEEQKLISEEDLN-----  349
CAA03380  EHLYHHHHHHEFEEQKLISEEDLN-----  349
CAA03377  EHLYHHHHHHEFEEQKLISEEDLN-----  349
Q9JHH6    RNT--------------------------  422
```

The presence of identifiable domains in the disclosed NOV8 protein was determined by using Pfam and then determining the Interpro number. The results are listed in Table 8L with the statistics and domain description.

TABLE 8L

Domain Analysis of NOV8

| PSSMs Producing Significant Alignments | Score (bits) | E Value |
|---|---|---|
| Zn_carbOpept: domain 1 of 1, from 50 to 332 | 384.8 | 8.7e-112 |

```
Zn_CarbOpept    YhnleeiyawlDllvsnfPdLvskvsiGksyeGRdlkvLKisdnpat
                |+   +++ +++ ++ ++ + +++  +|  +++  +++ ||++
NOV8            YHPMGEINEWMREISEKYKEVVTQHFLGVTYETHPIYYLKISQP--S Zn_CarbOpept    genePevfavagWiHAREwvtsAtllwllkelvanYgsDktitklldgld
                ++++++++++ ++ +||||++++|+++++++++++++  ++++++++++++
NOV8            GNPKKIIWMGCG-IHAREWIAPAFCQWFVKEILQNHKDNSRIRKLLRNLD Zn_CarbOpept    lfyilpvfNpDGyaYsittdSyRmWRKtRspnagsfcvGtDpNRNWyaqw
                ++++++ |+||++|+++++   |+|||  |++  + ++ |+|+|||+++ +
NOV8            -FYVLPVLNIDGYIYTWTTD--RLWRKSRSPHNNGTCFGTDLNRNFNASW Zn_CarbOpept    ggmgassysPcSetYeGtapfSepEtkavedfirswlgGGkqnIkayItf
                ++++++++ +    ++++|+ + |++|+++++ ++ + ++      |   ++++
NOV8            CSIGASR-NCQDQTFCGTGPVSEPETKAVASFIESKKD----DILCFLTM Zn_CarbOpept    HsYSqlllyPYgydynlnpdandldelsdlkiaadalsarhgtyYtlglp
                |+|+++++ ||+++ ++  ++ + +++    ++++++++++++++ |+++ +
NOV8            HSYGQLILTPYGYTKNKSSNHPEMIQVG--QKAANALKAKYGTNYRVG-S Zn_CarbOpept    gsstIYpasAGGsdDwaydvgiikyaftfElrpdtgsyGnPCFllPeeqI
                +++++|+++ |++ |++ + + +++++++|++ +++ +|    |++|+ +|
NOV8            SADILYASS-GSSRDWARDIG-IPFSYTFELR-DSGTYG---FVLPEAQI Zn_CarbOpept    iptgsee     (SEQ ID NO:173)
                +++++ +
NOV8            QPTCE-E     (SEQ ID NO:20)
```

Consistent with other known members of the carboxypeptidase family of proteins, NOV8 contains a zinc carboxypeptidase domain as illustrated in Table 8L.

NOV8 nucleic acids, and the encoded polypeptides, according to the invention are useful in a variety of applications and contexts. For example, NOV8 nucleic acids and polypeptides can be used to identify proteins that are members of the carboxypeptidase family of proteins. The NOV8 nucleic acids and polypeptides can also be used to screen for molecules, which inhibit or enhance NOV8 activity or function. Specifically, the nucleic acids and polypeptides according to the invention may be used as targets for the identification of small molecules that modulate or inhibit, e.g., digestion or hydrolysis of polypeptide chains. These molecules can be used to treat, e.g., pancreatitis, ulcers, inflammatory bowel disease, diverticular disease, Crohn's disease, appendicitis, or obesity.

In addition, various NOV8 nucleic acids and polypeptides according to the invention are useful, inter alia, as novel members of the protein families according to the presence of domains and sequence relatedness to previously described proteins. For example, the NOV8 nucleic acids and their encoded polypeptides include structural motifs that are characteristic of proteins belonging to the carboxypeptidase family. Carboxypeptidase B, (CPB) like carboxypeptidase A, is a pancreatic exopeptidase. Unlike carboxypeptidase A, however, carboxypeptidase B catalyzes the hydrolysis of the peptide bonds involving basic amino acids lysine, arginine and ornithine. This hydrolysis occurs at the C-terminal bond in these polypeptides.

The NOV8 nucleic acids and polypeptides, antibodies and related compounds according to the invention will be useful in therapeutic and diagnostic applications in the mediation of hydrolysis. As such the NOV8 nucleic acids and polypeptides, antibodies and related compounds according to the invention may be used to treat digestive disorders, e.g., xerostomia, hypercalceimia, ulcers, Von Hippel-Lindau (VHL) syndrome, cirrhosis, transplantation, inflammatory bowel disease, diverticular disease, hirschsprang's disease, crohn's disease, appendicitis, stroke, tuberous sclerosis, anxiety, pain, endocrine dysfunctions, nueroprotection, diabetes, obesity, growth and reproductive disorders, myasthenia gravis.

The NOV8 nucleic acids and polypeptides are useful for detecting specific cell types. For example, expression analysis has demonstrated that a NOV8 nucleic acid is expressed in pooled mammalian tissue, small intestine, and spinal cord.

Additional utilities for NOV8 nucleic acids and polypeptides according to the invention are disclosed herein.

NOV9

The disclosed NOV9 nucleic acid (alternatively referred to herein as CG56463–01) encodes a novel neurotransmitter receptor-like protein and includes the 1142 nucleotide sequence (SEQ ID NO:27) shown in Table 9A. The NOV9 nucleic acid disclosed herein maps to chromosome 6p23.

An open reading frame for the mature protein was identified beginning with an GCT codon at nucleotides 3–5, and ending with a TAA stop codon at nucleotides 1020–1022. Putative untranslated regions, if any, are found upstream from the initiation codon and downstream from the termination codon. The start and stop codons are in bold letters.

TABLE 9A

NOV9 Nucleotide Sequence (SEQ ID NO:27)

AGGCTGTGGAGCTGTGTTACAAGAACGTGAACGAATCCTGCATTAAAACTCCTTACTCGCCAGGTCCTCGATCTA
TCCTCTACGCCGTCCTTGGTTTTGGGGCTGTGCTGGCAGCGTTTGGAAACTTACTGGTCATGATTGCTATCCTTC
ACTTCAAACAACTGCACACACCTACAAACTTTCTGATTGCGTCGCTGGCCTGTGCTGACTTCTTGGTGGGAGTCA
CTGTGATGCCCTTCAGCACAGTGAGGTCTGTGGAGAGCTGTTGGTACTTTGGGGACAGTTACTGTAAATTCCATA
CATGTTTTGACACATCCTTCTGTTTTGCTTCTTTATTTCATTTATGCTGTATCTCTGTTGATAGATACATTGCTG
TTACTGATCCTCTGACCTATCCAACCAAGTTTACTGTGTCAGTTTCAGGGATATGCATTGTTCTTTCCTGGTTCT
TTTCTGTCACATACAGCTTTTCGATCTTTTACACGGGAGCCAACGAAGAAGGAATTGAGGAATTAGTAGTTGCTC
TAACCTGTGTAGGAGGCTGCCAGGCTCCACTGAATCAAAACTGGGTCCTACTTTGTTTTCTTCTATTCTTTATAC
CCAATGTCGCCATGGTGTTTATATACAGTAAGATATTTTTGGTGGCCAAGCATCAGGCTAGGAAGATAGAAAGTA
CAGCCAGCCAAGCTCAGTCCTCCTCAGAGAGTTACAAGGAAAGAGTAGCAAAAAGAGAGAGAAAGGCTGCCAAAA
CTTTGGGAATTGCTATGGCAGCATTTCTTGTCTCTTGGCTACCATACCTCGTTGATGCAGTGATTGATGCTTATA
TGAATTTTATAACTCCTCCTTATGTTTATGAGATTTTAGTTTGGTGTGTTTATTATAATTCAGCTATGAACCCCT
TGATTTATGCTTTCTTTTACCAATGGTTTGGGAAGGCAATAAAACTTATTGTAAGCGGCAAGGTCTTAAGGACTG
ATTCGTCAACAACTAATTTATTTTCTGAAGAAGTAGAGACAGATTAAAAACATTACTGTAGAGACCTCAAAACTA
ACTTGAAATTAAGGTCAAGTGCAAAAATAAACACTTGGACATAGAGAGGCAAGCATGATCATATGCCAAGTTGTA
GGACAATACATTCAATC

The NOV9 protein (SEQ ID NO:28) encoded by SEQ ID NO:27 is 339 amino acid residues in length and is presented using the one-letter amino acid code in Table 9B. The SignalP, Psort and/or Hydropathy results indicate that NOV9 has a signal peptide and is likely to be localized in the plasma membrane with a certainty of 0.6000. Alternatively, a NOV9 polypeptide is located to the Golgi body with a certainty of 0.4000, the endoplasmic reticulum (membrane) with a certainty of 0.3000, or the mitochondrial inner membrane with a certainty of 0.0300. The SignalP indicates a likely cleavage site for a NOV9 polypeptide is between positions 47 and 48, i.e., at the dash in the sequence MIA-IL.

In a BLAST search of public sequence databases, it was found, for example, that the NOV9 nucleic acid sequence of this invention has 601 of 1000 bases (60%) identical to a gb:GENBANK-ID:AR035954|acc:AR035954.1 mRNA from Unknown. (Sequence 1 from patent U.S. Pat. No. 5,871,967). Further, the full amino acid sequence of the disclosed NOV9 protein of the invention has 152 of 330 amino acid residues (46%) identical to, and 216 of 330 amino acid residues (65%) similar to, the 337 amino acid residue ptnr:SPTREMBL-ACC:O14804 protein from Human (PUTATIVE NEUROTRANSMITTER RECEPTOR).

The NOV9 protein of the invention also has homolgy to the proteins shown in the BLASTP data in Table 9D.

TABLE 9B

Encoded NOV9 Protein Sequence (SEQ ID NO:28)

AVELCYKNVNESCIKTPYSPGPRSILYAVLGFGAVLAAFGNLLVMIAILHFKQLHTPTNFLIASLACADFLVGVT
VMPFSTVRSVESCWYFGDSYCKFHTCFDTSFCFASLFHLCCISVDRYIAVTDPLTYPTKFTVSVSGICIVLSWFF
SVTYSFSIFYTGANEEGIEELVVALTCVGGCQAPLNQNWVLLCFLLFFIPNVAMVFIYSKIFLVAKHQARKIEST
ASQAQSSSESYKERVAKRERKAAKTLGIAMAAFLVSWLPYLVDAVIDAYMNFITPPYVYEILVWCVYYNSAMNPL
IYAFFYQWFGKAIKLIVSGKVLRTDSSTTNLFSEEVETD

SNP variants of NOV9 are disclosed in Example 2.

A search against the Patp database, a proprietary database that contains sequences published in patents and patent publication, yielded several homologous proteins shown in Table 9C.

TABLE 9C

PatP Results for NOV9

| Sequences Producing High-Scoring Segment Pairs: | | High Score | Smallest Sum Prob P (N) |
|---|---|---|---|
| patp:AAB18764 | Amino acid sequence of the human SNORF1 receptor | 1782 | 1.8e−183 |
| patp:AAB18765 | Amino acid sequence of the rat SNORF1 receptor | 1592 | 2.5e−163 |
| patp:AAG80970 | Human nGPCR40 #2 | 1307 | 3.9e−133 |
| patp:AAG72611 | Human OR-like polypeptide query sequence | 1257 | 7.8e−128 |
| patp:AAU25611 | Human G Protein-Coupled Receptor (GPCR) polypeptide #58 | 1251 | 3.4e−127 |

TABLE 9D

NOV9 BLASTP Results

| Gene Index/ Identifier | Protein/Organism | Length of aa | Identity (%) | Positives (%) | Expect Value |
| --- | --- | --- | --- | --- | --- |
| Q96RI9 | TRACE AMINE RECEPTOR 3 - *Homo sapiens* (Human) | 348 | 339/339 (100%) | 339/339 (100%) | 2.3e−183 |
| Q923Y6 | TRACE AMINE RECEPTOR 3 - *Rattus norvegicus* (Rat) | 338 | 293/334 (87%) | 314/334 (94%) | 3.2e−163 |
| Q923Y2 | TRACE AMINE RECEPTOR 8 - *Rattus norvegicus* (Rat) | 358 | 241/332 (72%) | 285/332 (85%) | 4.7e−137 |
| Q923X5 | TRACE AMINE RECEPTOR 15 - *Rattus norvegicus* (Rat) | 358 | 234/334 (70%) | 281/334 (84%) | 3.4e−134 |
| Q923X8 | TRACE AMINE RECEPTOR 12 - *Rattus norvegicus* (Rat) | 333 | 236/333 (70%) | 280/333 (84%) | 4.4e−134 |

A multiple sequence alignment is given in Table 9E, with the NOV9 protein of the invention being shown in line 1 in a ClustalW analysis comparing NOV9 with related protein sequences of Table 9D.

Table 9E. ClustalW Analysis of NOV9

1. SEQ ID NO.: 28    NOV9
2. SEQ ID NO.: 174    Q96RI9
3. SEQ ID NO.: 175    Q923Y6
4. SEQ ID NO.: 176    Q923Y2
5. SEQ ID NO.: 177    Q923X5
6. SEQ ID NO.: 178    Q923X8

```
                       10        20        30        40        50        60
                ....|....|....|....|....|....|....|....|....|....|....|....|
NOV9     ------------------------AVELCYKNVNESCIKTPYSPGPRSILYAVLGFGAVL  36
Q96RI9   ---------------MVNNFSQAEAVELCYKNVNESCIKTPYSPGPRSILYAVLGFGAVL  45
Q923Y6   -----------------------MELCYENVNGSCIKSSYSPWPRAILYAVLGLGAIL  35
Q923Y2   MDKLVDNFLSGQSRTMSEDLLSASSPQLCYENLNGSCIRSPYSPGPRLILYAVFGFGAVL  60
Q923X5   MRVDDDRFPWDQDSILSRDLLSASSLQLCYENLNRSCVRSPYSPGPRLILYAVFGFGAVL  60
Q923X8   -----------------------MQLCYEKLNRSCVRSPYSPGPRLILYAVFGFGAVL  35

70        80        90       100       110       120
                ....|....|....|....|....|....|....|....|....|....|....|....|
NOV9     AAFGNLLVMIAILHFKQLHTPTNFLIASLACADFLVGVTVMPFSTVRSVESCWYFGDSYC  96
Q96RI9   AAFGNLLVMIAILHFKQLHTPTNFLIASLACADFLVGVTVMPFSTVRSVESCWYFGDSYC 105
Q923Y6   AVFGNLLVITAILHFKQLHTPTNFLVASLACADFLVGVTVMPFSTVRSVEGCWYFGDIYC  95
Q923Y2   AVCGNLLVMTSILHFRQLHSPANFLVASLACADFLVGLTVMPFSTVRSVEGCWYFGDIYC 120
Q923X5   AVCGNLMVMTSILHFRQLHSPANFLVASLACADFLVGLTVMPFSMVRSVEGCWYFGDIYC 120
Q923X8   AVCGNLLVMTSILHFRQLHSPANFLVASLACADFLVGLTVMPFSMVRSVEGCWYFGDIYC  95

130       140       150       160       170       180
                ....|....|....|....|....|....|....|....|....|....|....|....|
NOV9     KFHTCFDTSFCFASLFHLCCISVDRYIAVTDPLTYPTKFTVSVSGICIVLSWFFSVTYSF 156
Q96RI9   KFHTCFDTSFCFASLFHLCCISVDRYIAVTDPLTYPTKFTVSVSGICIVLSWFFSVTYSF 165
Q923Y6   KFHTCFDTSFCFASLFHLCCISIDRYVAVTDPLTYPTKFTISVSGVCIALSWFFSVTYSF 155
Q923Y2   KFHSCFEGSFCYSSIFHLCFISVDRYIAVSDPLIYPTRFTASVSGKCITFSWLLSIIYSF 180
Q923X5   KLHTCFDVSFCYCSLFHLCFISVDRYIAVSDPLIYPTRFTASVSGKCITFSWLLSIIYGF 180
Q923X8   KFHSSFDGSFCYSSIFHLCFISADRYIAVSDPLIYPTRFTASVSGKCITFSWLLSIIYSF 155

190       200       210       220       230       240
                ....|....|....|....|....|....|....|....|....|....|....|....|
NOV9     SIFYTGANEEGIEELVVALTCVGGCQAPLNQNWVLLCFLLFFIPNVAMVFIYSKIFLVAK 216
Q96RI9   SIFYTGANEEGIEELVVALTCVGGCQAPLNQNWVLLCFLLFFIPNVAMVFIYSKIFLVAK 225
Q923Y6   SIFYTGANEEGIEELVVALTCVGGCQAPLNQNWVLLCFLLFFLPTVVMVFLYGRIFLVAK 215
Q923Y2   SLLYTGANEAGLEDLVSALTCVGGCQIAVNQSWVFINFLLFLVPTLVMMTVYSKIFLIAK 240
Q923X5   PLIYTGASEAGIEDLVSALTCVGGCQIPMNQKEVLINFLLFLVPTLVMMTYYSKIFLIAR 240
Q923X8   SIFYTGVNEAGLEDLVSALTCVGGCQIAVNQSWVFINFLLFLVPALVMMTYYSKIFLIAK 215

250       260       270       280       290       300
                ....|....|....|....|....|....|....|....|....|....|....|....|
NOV9     HQARKIESTASQAQSSSESYKERVAKRERKAAKTLGIAMAAFLVSWLPYLVDAVIDAYMN 276
Q96RI9   HQARKIESTASQAQSSSESYKERVAKRERKAAKTLGIAMAAFLVSWLPYLVDAVIDAYMN 285
Q923Y6   QQARKIEGSANQPQASSESYKERVARRERKAAKTLGIAMAAFLVSWLPYIIDAVIDAYMN 275
Q923Y2   QQAQNIEKMSKQTTRASESYKDRVAKRERKAAKTLGIAVAAFLLSWLPYFIDSIIDAFLG 300
Q923X5   QQAQNIEKMRKQTARASESYKDRVCKRERKAAKTLGIAVAAFLLSWLPYFIDSIIDAFLG 300
Q923X8   QQAQNIEKMGKQTARASESYKDRVAKRERKAAKTLGIAVAAFLLSWLPYFIDSIIDAFLG 275

310       320       330       340       350       360
```

```
                137                              138
        ....|....|....|....|....|....|....|....|....|....|....|....|
NOV9    FITPPYVYEILVWCVYYNSAMNPLIYAFFYQWFGKAIKLIVSGKVLRTDSSTTNLFSEEV 336
Q96RI9  FITPPYVYEILVWCVYYNSAMNPLIYAFFYQWFGKAIKLIVSGKVLRTDSSTTNLFSEEV 345
Q923Y6  FITPAYVYEILVWCVYYNSAMNPLIYAFFYPWFRKAIKLIVSGKVFRADSSRTNLFSEEA 335
Q923Y2  FITPTYVYEILVWIAYYNSAMNPLIYAFFYPWFRKAIKLIVGKILRQNSSVTNLFPE-- 358
Q923X5  FITPTYVYEILWIVYYNSSMNPLIYAFFYPWFRKATKLIVGKILRENSSTINLFPE-- 358
Q923X8  FVTPTYVYEILVWIGYYNSAMNPLIYAFFYPWFRKAIKLIVGKILRENSSATNLFPE-- 333

...
NOV9    ETD 339
Q96RI9  ETD 348
Q923Y6  GAG 338
Q923Y2  --- 358
Q923X5  --- 358
Q923X8  --- 333
```

The presence of identifiable domains in the disclosed NOV9 protein was determined by using Pfam and then determining the Interpro number. The results are listed in Table 9F with the statistics and domain description.

domains and sequence relatedness to previously described proteins. For example, the NOV9 nucleic acid and polypeptide include structural motifs that are characteristic of proteins belonging to the family of neurotransmitter receptor

TABLE 9F

Domain Analysis of NOV9

|  | | Score (bits) | E Value |
|---|---|---|---|
| PSSMs Producing Significant Alignments | | | |
| 7tm_1: domain 1 of 2, from 40 to 156 | | 144.4 | 8.9e-45 |

```
7tm_1      GNlLVilvilrtkklrtptnifilNLAvADLLflltlppwalyylvg
           ||+||+++++  +++++++++++ +||  |||+|+++++++++++ ++
NOV9       GNLLVMIAILHFKQLHTPTNFLIASLACADFLVGVTVMPFSTVRSVE 7tm_1      gsedWpfGsalCklvtaldvvnmyaSillLtaISiDRYlAIvhPlryrrr
           + | +|+  |++ +++++ ++++| ++|++||+|||+|+++|+ ++++
NOV9       --SCWYFGDSYCKFHTCFDTSFCFASLFHLCCISVDRYIAVTDPLTYPTK 7tm_1      rtsprrAkvvillvWvlalllsl       (SEQ ID NO:179)
           + + +  + +++ |++++ ++
NOV9       FT-VSVSGICIVLSWFFSVTYSF       (SEQ ID NO:28)
```

| 7tm_1: domain 2 of 2, from 190 to 302 | | 82.0 | 4.1e-25 |
|---|---|---|---|

```
7tm_1      llstlvgFllPllvilvcYtrIlrtlr....................
           ++++++ |++| + +++ |+ |+ +++++ ++ +++ ++ ++++++
NOV9       VLLCFLLFFIPNVAMVFIYSKIFLVAKhqarkiestasqaqsssesy 7tm_1      .........kaaktllvvvvvFvlCWlPyfivllldtlc.lsiimsstCe
           +++  ++++++++++++ + +|+++|+|+ + +++++++++
NOV9       kervakrerKAAKTLGIAMAAFLVSWLPYLVDAVIDAYMnFI--------

7tm_1      lervlptallvtlwLayvNsclNPiIY    (SEQ ID NO:180)
           ++++++ + +++ + |+++||+||
NOV9       ---TPPYVYEILVWCVYYNSAMNPLIY    (SEQ ID NO:28)
```

Consistent with other known members of the neurotransmitter recpetor family of proteins, NOV9 contains 7-transmembrane domains as illustrated in Table 9F.

The NOV9 nucleic acid, and the encoded polypeptide, according to the invention are useful in a variety of applications and contexts. For example, NOV9 nucleic acids and polypeptides can be used to identify proteins that are members of the neurotransmitter receptor family of proteins. The NOV9 nucleic acids and polypeptides can also be used to screen for molecules, which inhibit or enhance NOV9 activity or function. Specifically, the nucleic acids and polypeptides according to the invention may be used as targets for the identification of small molecules that modulate or inhibit, e.g., cellular recognition, or G-protein-mediated transduction of neuromuscular/synaptic signals. These molecules can be used to treat, e.g., neurological disorders, immune diseases, or signal transduction pathways.

In addition, the NOV9 nucleic acid and polypeptide according to the invention are useful, inter alia, as novel members of the protein families according to the presence of proteins. Nerve cells are highly specialized for cell-to-cell communication. A number of small molecules called neurotransmitters act as the actual signals, released from one nerve cell only to dock on another cell. There are numerous subtypes of receptor for any given neurotransmitter. Docking molecules, or receptors, act as gates, triggered by the neurotransmitter. When a neurotransmitter molecule fits into a receptor, it typically opens the gate, allowing ions to travel through the cell's membrane. The ions, in turn, excite the cell. If the receiving cell is a nerve cell, this excitation can lead to release of its own neurotransmitters.

The vast majority of neurotransmitter receptors belong to a class of proteins known as the serpentine receptors. This class exhibits a characteristic transmembrane structure: spaning the cell membrane, seven times. The link between neurotransmitters and intracellular signaling is carried out by association either with G-proteins (small GTP-binding and hydrolyzing proteins) or with protein kinases, or by the receptor itself in the form of a ligand-gated ion channel (for example, the acetylcholine receptor). An additional characteristic of neurotransmitter receptors is that they are subject to ligand-induced desensitization: such that they can become unresponsive upon prolonged exposure to their neurotransmitter.

The NOV9 nucleic acid and polypeptide, antibodies and related compounds according to the invention will be useful in therapeutic and diagnostic applications in the mediation of signal transduction. As such the NOV9 nucleic acid and polypeptide, antibodies and related compounds according to the invention may be used to treat, e.g., leukemia, acute nonlymphocytic, spinocerebellar ataxia-1, or neurological disorders.

The NOV9 nucleic acid and polypeptide are useful for detecting specific cell types. For example, expression analysis has demonstrated that a NOV9 nucleic acid is predominantly expressed in skeletal muscle and selected areas of the brain.

Additional utilities for the NOV9 nucleic acid and polypeptide according to the invention are disclosed herein.

NOV10

The disclosed NOV10 nucleic acid (alternatively referred to herein as CG56321-01) encodes a novel proto-oncogene MAF-like protein and includes the 1189 nucleotide sequence (SEQ ID NO:29) shown in Table 10A. The NOV10 nucleic acid disclosed herein maps to chromosome 8.

An open reading frame for the mature protein was identified beginning with an ATG initiation codon at nucleotides 85–87, and ending with a TAG stop codon at nucleotides 11441146. Putative untranslated regions, if any, are found upstream from the initiation codon and downstream from the termination codon. The start and stop codons are in bold letters.

TABLE 10A

NOV10 Nucleotide Sequence (SEQ ID NO:29)

GGGAGCAGGGGGGGAGAGGCCTGCAGCTCCCCCACCACTCCCACGCCGCCCGTCGGGGCGCGGCCGGGCGCGGG
CCCCGGGCGATGGCCGCGGAGCTGGCGATGGGCGCCGAGCTGCCCAGCAGCCCGCTGGCCATCGAGTACGTCAAC
GACTTCGACCTGATGAAGTTCGAGGTGAAGAAGGAGCCTCCCGAGGCCGAGCGCTTCTGCCACCGCCTGCCGCCA
GGCTCGCTGTCCTCGACGCCGCTCAGCACGCCCTGCTCCTCCGTGCCCTCCTCGCCCAGCTTCTGCGCGCCCAGC
CCGGGCACCGGCGGCGGCGGCGGCGCGGGGGGCGGCGGCGGCTCGTCTCAGGCCGGGGGCGCCCCCGGGCCGCCG
AGCGGGGGCCCCGGCGCCGTCGGGGGCACCTCGGGGAAGCCGGCGCTGGAGGATCTGTACTGGATGAGCGGCTAC
CAGCATCACCTCAACCCCGAGGCGCTCAACCTGACGCCCGAGGACGCGGTGGAGGCGCTCATCGGCAGCGGCCAC
CACGGCGCGCACCACGGCGCGCACCACCCGGCGGCCGCCGCAGCCTACGAGGCTTTCCGCGGCCCGGGCTTCGCG
GGCGGCGGCGGAGCGGACGACATGGGCGCCGGCCACCACCACGGCGCGCACCACGCCGCCCACCATCACCACGCC
GCCCACCACCACCACCACCACCACCACCACCATGGCGGCGCGGGACACGGCGGTGGCGCGGGCCACCACGTGCGC
CTGGAGGAGCGCTTCTCCGACGACCAGCTGGTGTCCATGTCGGTGCGCGAGCTGAACCGGCAGCTCCGCGGCTTC
AGCAAGGAGGAGGTCATCCGGCTCAAGCAGAAGCGGCGCACGCTCAAGAAACCGCGGCTACGCGCAGTCCTGCCGC
TTCAAGCGGGTGCAGCAGCGGCACATTCTGGAGAGCGAGAAGTGCCAAACTCCAGAGCCAGGTGGAGCAGCTGAAG
CTGGAGGTGGGGCGCCTGGCCAAAGAGCGGGACCTGTACAAGGAGAAATACGAGAAGCTGGCGGGCCGGGGCGGC
CCCGGGAGCGCGGGCGGGGCCGGTTTCCCGCGGGAGCCTTCGCCGCCGCAGGCCGGTCCCGGCGGGGCCAAGGGC
ACGGCCGACTTCTTCCTGTAGGCGCCGGACCCCGAGCCCGCGCCGCCGTCGCCGGGGACAAGTT

The NOV10 protein (SEQ ID NO:30) encoded by SEQ ID NO:29 is 353 amino acid residues in length and is presented using the one-letter amino acid code in Table 10B. The SignalP, Psort and/or Hydropathy results indicate that NOV10 has no known signal peptide and is likely to be localized in the nucleus with a certainty of 0.7600. Alternatively, a NOV10 polypeptide is located to the microbody (peroxisome) with a certainty of 0.5418, the lysosome (lumen) with a certainty of 0.1882, or the mitochondrial matrix space with a certainty of 0.1000.

TABLE 10B

Encoded NOV10 Protein Sequence (SEQ ID NO:30)

MAAELAMGAELPSSPLAIEYVNDFDLMKFEVKKEPPEAERFCHRLPPGSLSSTPLSTPCSSVPSSPSFCAPSPGT
GGGGGAGGGGGSSQAGGAPGPPSGGPGAVGGTSGKPALEDLYWMSGYQHHLNPEALNLTPEDAVEALIGSGHHGA
HHGAHHPAAAAAYEAFRGPGFAGGGGADDMGAGHHHGAHHAAHHHHAAHHHHHHHHHGGAGHGGGAGHHVRLEE
RFSDDQLVSMSVRELNRQLRGFSKEEVIRLKQKRRTLKNRGYAQSCRFKRVQQRHILESEKCQLQSQVEQLKLEV
GRLAKERDLYKEKYEKLAGRGGPGSAGGAGFPREPSPPQAGPGGAKGTADFFL

A search against the Patp database, a proprietary database that contains sequences published in patents and patent publication, yielded several homologous proteins shown in Table 10C.

TABLE 10C

PatP Results for NOV10

| Sequences Producing High-Scoring Segment Pairs: | High Score | Smallest Sum Prob P (N) |
|---|---|---|
| patp:AAB94964 Human protein sequence | 670 | 1.2e−65 |
| patp:AAY31232 Human c-Maf protein | 452 | 1.6e−42 |
| patp:AAB43201 Human ORFX ORF2965 polypeptide sequence | 260 | 1.6e−28 |
| patp:AAE03948 Human gene 1 encoded secreted protein fragment | 253 | 1.9e−21 |
| patp:AAB93529 Human protein sequence | 238 | 7.5e−20 |

In a BLAST search of public sequence databases, it was found, for example, that the NOV10 nucleic acid sequence of this invention has 258 of 322 bases (80%) identical to a gb:GENBANK-ID:AF034693 |acc:AF034693.1 mRNA from *Coturnix japonica* (*Coturnix coturnix japonica* bZip transcription factor MafA (mafA) gene, complete cds). Further, the full amino acid sequence of the disclosed NOV10 protein of the invention has 134 of 249 amino acid residues (53%) identical to, and 151 of 249 amino acid residues (60%) similar to, the 311 amino acid residue ptnr:SP-TREMBL-ACC:Q90370 protein from *Coturnix cotumix japonica* (Japanese quail) (MAFB PROTEIN).

The NOV10 protein of the invention also has homolgy to the proteins shown in the BLASTP data in Table 10D.

TABLE 10D

NOV10 BLASTP Results

| Gene Index/ Identifier | Protein/Organism | Length of aa | Identity (%) | Positives (%) | Expect Value |
|---|---|---|---|---|---|
| Q90370 | MAFB PROTEIN - *Coturnix coturnix japonica* (Japanese quail) | 311 | 134/249 (53%) | 151/249 (60%) | 1.3e−77 |
| Q90888 | MAFB - *Gallus gallus* (Chicken) | 311 | 132/249 (53%) | 152/249 (61%) | 4.2e−77 |
| Q98UK4 | C-MAF - *Brachydanio rerio* (Zebrafish) (Zebra danio) | 327 | 186/339 (54%) | 212/339 (62%) | 1.9e−76 |
| Q98UK5 | TRANSCRIPTION FACTOR MAFB - *Brachydanio rerio* (Zebrafish) (Zebra danio) | 356 | 181/353 (51%) | 212/353 (60%) | 1.1e−71 |
| O73679 | TRANSCRIPTION FACTOR VAL - *Brachydanio rerio* (Zebrafish) (Zebra danio) | 356 | 181/353 (51%) | 212/353 (60%) | 1.1e−71 |

A multiple sequence alignment is given in Table 10E, with the NOV10 protein of the invention being shown in line 1 in a ClustalW analysis comparing NOV10 with related protein sequences of Table 10D.

Table 10E. ClustalW Analysis of NOV10

1. SEQ ID NO.: 30   NOV10
2. SEQ ID NO.: 181  Q90370
3. SEQ ID NO.: 182  Q90888
4. SEQ ID NO.: 183  Q98UK4
5. SEQ ID NO.: 184  Q98UK5
6. SEQ ID NO.: 185  O73679

147                                                    148

```
              10         20         30         40         50         60
              ....|....|....|....|....|....|....|....|....|....|....|....|
NOV10    MAAELAMG-AELPSSPLAIEYVNDFDLMKFEVKKEPPEA-----ERFCHRLPP-GSLSST  53
Q90370   MAGELSTG-AELPTSPLAMEYVNDFDLMKFDVKKEPLGRNDRS-GRHCTRLQPAGSVSST  58
Q90888   MAGELSTG-AELPTSPLAMEYVNDFDLMKFDVKKEPLGRNDRS-GRHCTRLQPAGSVSST  58
Q98UK4   MASELAMSSDLPTSPLAMEYVNDFDLMKFEVKKEPVEP-DRS-ISQCSRLIAGGSLSST  58
Q98UK5   MSADLAMG-PELPTSPLAIEYVNDFDLMKFEVKKEAMAAHDRANIRQCNRLQPQGSVSST  59
O73679   MSADLAMG-PELPTSPLAIEYVNDFDLMKFEVKKEAMAAHDRANIRQCNRLQPQGSVSST  59

70         80         90        100        110        120
              ....|....|....|....|....|....|....|....|....|....|....|....|
NOV10    PLSTPCSSVPSSPSFCAPSPGTGGGGGAGGGGGSSQAGGAPGPPSGGPGAVGGTSGKPAL 113
Q90370   PISTPCSSVPSSPSFSP-------------------------------TEQKTHL  82
Q90888   PISTPCSSVPSSPSFSP-------------------------------TEQKTHL  82
Q98UK4   PMSTPCSSVPPSPSFSAPSPGSG-------------------------SEQKAHL  88
Q98UK5   PISTPCSSVPSSPSFSP-------------------------------TEQKNHL  83
O73679   PISTPCSSVPSSPSFSP-------------------------------TEQKNHL  83

130        140        150        160        170        180
              ....|....|....|....|....|....|....|....|....|....|....|....|
NOV10    EDLYWMSG--YQHHLNPEALNLTPEDAVEALIGS------------GHHG----AHHGA 154
Q90370   EDLYWMAN-SY-QQMNPEAILTPEDAVEALIGS--------HQVSQQLQG--FESFR-A 129
Q90888   EDLYWMAN-SY-QQMNPEAILTPEDAVEALIGS--------HQVSQQLQG--FESFR-A 129
Q98UK4   EDFYWMTG--YQQOLNPEALGFSPEDAVEALISS----------SHQLS--FDGYARG 133
Q98UK5   EDLYWMPSGAYPQQLDPQTLSLTPEDAVEALIGATAHGHPPPPHVQQLQAGAFDGYRGA 143
O73679   EDLYWMPSGAYPQQLDPQTLSLTPEDAVEALIGATAHGHPPPPHVQQLQAGAFDGYRGA 143

190        200        210        220        230        240
              ....|....|....|....|....|....|....|....|....|....|....|....|
NOV10    HHPAAAA-------AYEAFRGPGFAGGGG---ADDMGAG--HHHGAHHAAHHHHAAHHHHH 203
Q90370   HHHHHHH--------HQHHHHQYPAVTH--EDLAGSG-----HPHHHHHHHHQASP-TP 172
Q90888   HHHHHHH--------HQHHHHQYPAVTH--EDLAGSG-----HPHHHHHHHHQASP-TP 172
Q98UK4   QQFGSAAG------AGGAMAGEEMGSAAAVVSAVIAAAAQNGAPHHHHHHHHHPAGHH 187
Q98UK5   HHHHGHAQQQQQQQPQHHHQHQYGATPHHPDDLSGHPGAHGHHPHHHHHHHSQDPDSP 203
O73679   HHHHGHAQQQQQQQPQHHHQHQYGATPHHPDDLSGHPGAHGHHPHHHHHHHSQDPDSP 203

250        260        270        280        290        300
              ....|....|....|....|....|....|....|....|....|....|....|....|
NOV10    HHHHHGGAGHGGGAGHHV--------------RLEERFSDDQLVSMSVRELNRQLRGF 247
Q90370   STSSSSSQQLQTSHQQHPPSS------------SVEDRFSDDQLVSMSVRELNRHLRGF 219
Q90888   STSSSSSQQLQTSHQQHPPSS------------SVEDRFSDDQLVSMSVRELNRHLRGF 219
Q98UK4   HHAAPGAQSNGASAGHP-GH------------MHLDERFSDEQLVNMSVRELNRQLRGV 234
Q98UK5   SPTSPEQLHHRHHHHHHPHGHPGQQGHHGVGGGLNVEDRFSDDQLVIMSVRELNRHLRGF 263
O73679   SXTSPEQXHHRHHHHHHPHGHPGQQGHHGVGGGLNVEDRFSDDQLVIMSVRELNRHLRGF 263

310        320        330        340        350        360
              ....|....|....|....|....|....|....|....|....|....|....|....|
NOV10    SKEEVIRLKQKRRTLKNRGYAQSCREKRVQQRHILESEKCQLQSQVEQLKLEVGRLAKER 307
Q90370   TKDEVIRLKQKRRTLKNRGYAQSCRYKRVQQKHHLENEKTQLIQQVEQLKQEVTRLARER 279
Q90888   TKDEVIRLKQKRRTLKNRGYAQSCRYKRVQQKHHLENEKTQLIQQVEQLKQEVTRLARER 279
Q98UK4   SKEEVIRLKQKRRTLKNRGYAQSCRYKRVQQRHMLEGEKTQLMQQVDHLKQEISRLVRER 294
Q98UK5   TKDEVIRLKQKRRTLKNRGYAQSCREKRVQQKHLLENEKTQLINQVEQLKQELNRLARER 323
O73679   TKDEVIRLKQKRRTLKNRGYAQSCREKRVQQKHLLENEKTQLINQVEQLKQELNRLARER 323

370        380        390        400
```

```
              149                                 150
         ....|....|....|....|....|....|....|....|....|.
NOV10    DLYKEKYEKLAGRGGPGSAGGAGFPREPSPPQAGPGGAKGTADFFL 353
Q90370   DAYKLKCEKLA---------SNGFREAGSTSDN-PS----SPEFFM 311
Q90888   DAYKLKCEKLA---------SNGFREAGSTSDN-PS----SPEFFM 311
Q98UK4   DAYKEKYEKLI---------SSGFRENGSSSDNNPS----SPEFFM 327
Q98UK5   DAYKLKCEKLTG--------ANGFREAGSTSDN-PS----SPEFFM 356
O73679   DAYKLKCEKLTG--------ANGFREAGSTSDN-PS----SPEFFM 356
```

The presence of identifiable domains in the disclosed NOV10 protein was determined by using Pfam and then determining the Interpro number. The results are listed in Table 10F with the statistics and domain description.

TABLE 10F

Domain Analysis of NOV10

| PSSMs Producing Significant Alignments | Score (bits) | E Value |
|---|---|---|
| bZIP_Maf: domain 1 of 1, from 185 to 334 | 237.7 | 1.7e-67 |

```
MAF      askeskaqsaqlsptSppgaghvapaSagggggaGSgytimsgvGGG
         +++    ++++  ++          ++       +++++|
NOV10    HHGAHHAAHHHHAA-------HHHHHHHHHHGGAG-----------

MAF      sCvitRAALqPCRPLnqqlmsssgsvspsagsGapSplsledrfSDeqLV
                                         ++  |+   +  +++++||++||
NOV10    --------------------------------HGGGAGHHVRLEERFSDDQLV MAF      smSVRELNRtLkLRGlskeEvvRLKQKRRTLKNRGYAqsCRaKRvqQkhe
         ++||||||||   +|||++++|++|||||||||||||||++|+|||++|++
NOV10    SMSVRELNR--QLRGFSKEEVIRLKQKRRTLKNRGYAQSCRFKRVQQRHI MAF      LEkeKaqLaqQleqLkeEvsrlarErDaykakyerLlsfivpvARsPvsg
         ||++|++|+  |+++|+  |+++++  |+|++++++++|+  +         +
NOV10    LESEKCQLQSQVEQLKLEVGRLAKERDLYKEKYEKLAGRG--------GP MAF      ageagsssdsp      (SEQ ID NO:186)
         ++ ++++ + +
NOV10    GSAGGAGFPRE      (SEQ ID NO:30)
```

Consistent with other known members of the basic leucine zipper (bZip) transcription factor family of proteins, NOV10 contains MAF domains as illustrated in Table 10F.

The NOV10 nucleic acid, and the encoded polypeptide, according to the invention are useful in a variety of applications and contexts. For example, NOV10 nucleic acids and polypeptides can be used to identify proteins that are members of the bZip transcription factor family of proteins. The NOV10 nucleic acids and polypeptides can also be used to screen for molecules, which inhibit or enhance NOV10 activity or function. Specifically, the nucleic acids and polypeptides according to the invention may be used as targets for the identification of small molecules that modulate or inhibit, e.g., gene regulation/expression. These molecules can be used to treat, e.g., autoimmune disorders or antioxidant induction of molecules such as NQO1, GST, Ya, or other detoxification enzymes.

In addition, the NOV10 nucleic acid and polypeptide according to the invention are useful, inter alia, as novel members of the protein families according to the presence of domains and sequence relatedness to previously described proteins. For example, the NOV10 nucleic acid and polypeptide include structural motifs that are characteristic of proteins belonging to the family of bZip transcription factor proteins. Transcription factors are proteins that bind to the enhancer or promoter regions and interact such that transcription occurs from only a small group of promoters in any cell. Most transcription factors can bind to specific DNA sequences, and these trans-regulatory proteins can be grouped together in families based on similarities in structure. Within such a family, proteins share a common framework structure in their respective DNA-binding sites, and slight differences in the amino acids at the binding site can alter the sequence of the DNA to which it binds. In addition to having this sequence-specific DNA-binding domain, transcription factors contain a domain involved in activating the transcription of the gene whose promoter or enhancer it has bound. Usually, this trans-activating domain enables that transcription factor to interact with proteins involved in binding RNA polymerase. This interaction often enhances the efficiency with which the basal transcriptional complex can be built and bind RNA polymerase II. There are several families of transcription factors.

The bZip transcription factor family of proteins are dimers, each of whose subunits contains a basic DNA-binding domain at the carboxyl end, followed closely by an a helix containing several leucine residues. These leucines are placed in the helix such that they interact with similarly spaced leucine residues on other bZip proteins to form a "leucine zipper" between them, causing dimers to form. This domain is followed by a regulatory domain that can interact with the promoter to stimulate or repress transcription.

The NOV10 nucleic acid and polypeptide, antibodies and related compounds according to the invention will be useful in therapeutic and diagnostic applications in the mediation of gene transcription. As such the NOV10 nucleic acid and polypeptide, antibodies and related compounds according to the invention may be used to treat, e.g., anemia, ataxia-telangiectasia, autoimmume disease, cancer, immunodeficiencies, hemophilia, hypercoagulation, idiopathic thrombocytopenic purpura, allergies, transplantation, graft versus host disease (GVHD), lymphaedema, systemic lupus erythematosus, asthma, emphysema, scleroderma, ARDS, diabetes, renal artery stenosis, interstitial nephritis, glomerulonephritis, polycystic kidney disease, systemic lupus erythematosus, renal tubular acidosis, IgA nephropathy, hypercalceimia, or Lesch-Nyhan syndrome.

The NOV10 nucleic acid and polypeptide are useful for detecting specific cell types. For example, expression analysis has demonstrated that a NOV10 nucleic acid is expressed in blood, lymphocyte, whole embryo, lung, pancreas, kidney and eye.

Additional utilities for the NOV10 nucleic acid and polypeptide according to the invention are disclosed herein.

NOV11

The NOV11 proteins descibed herein are novel lysyl oxidase-like proteins. The NOV11 nucleic acids disclosed herein map to chromosome 10. Two alternative novel NOV11 nucleic acids and polypeptides are disclosed herein, namely NOV11a and NOV11b.

NOV11a

A NOV11 variant is NOV11a (alternatively referred to herein as CG56381-01), which encodes the 2599 nucleotide sequence (SEQ ID NO:31) shown in Table 11A. An open reading frame for the mature protein was identified beginning with an ATG codon at nucleotides 78–80 and ending with a TGA codon at nucleotides 2568–2570. Putative untranslated regions, if any, downstream from the termination codon and upstream from the initiation codon are underlined. The start and stop codons are in bold letters.

The NOV11a protein (SEQ ID NO:32) encoded by SEQ ID NO:31 is 830 amino acid residues in length and is presented using the one-letter amino acid code in Table 11 B. The SignalP, Psort and/or Hydropathy results indicate that NOV11a has a signal peptide and is likely to be localized in the lysosome (lumen) with a certainty of 0.4247. Alternatively, a NOV11a polypeptide is located extracellularly with a certainty of 0.3700, the microbody (peroxisome) with a certainty of 0.1250, or the endoplasmic reticulum (membrane) with a certainty of 0.1000. The SignalP indicates a likely cleavage site for a NOV11a peptide between positions 24 and 25, i.e., at the dash in the sequence SRP-QS.

TABLE 11A

NOV11a Nucleotide Sequence (SEQ ID NO:31)

CCGCCGCGGCGCCCGCCCAGCCCCGGACTGTCCGCGCTCCATCTGGTATCTTGGCCTCAGCTGTCCTTGAAGTCA
CCATGGCGTGGTCCCCACCAGCCACCCTCTTTCTGTTCCTGCTGCTGCTAGGCCAGCCCCCTCCCAGCAGGCCAC
AGTCACTGGGCACCACTAAGCTCCGGCTGGTGGGCCCAGAGAGCAAGCCAGAGGAGGGCCGCCTGGAGGTGCTGC
ACCAGGGCCAGTGGGGCACCGTGTGTGATGACAACTTTGCTATCCAGGAGGCCACAGTGGCTTGCCGCCAGCTGG
GCTTCGAAGCTGCCTTGACCTGGGCCCACAGTGCCAAGTACGGCCAAGGGGAGGGACCCATCTGGCTGGACAATG
TGCGCTGTGTGGGCACAGAGAGCTCCTTGGACCAGTGCGGGTCTAATGGCTGGGGAGTCAGTGACTGCAGTCACT
CAGAAGACGTAGGGGTGATATGCCACCCCCGGCGCCATCGTGGCTACCTTTCTGAAACTGTCTCCAATGCCCTTG
GGCCCCAGGTGAGGAGGCTGGGCCGGCGGCTGGAGGAGGTGCGGCTCAAGCCCATCCTTGCCAGTGCCAAGCAGC
ATAGCCCAGTGACCGAGGGAGCCGTGGAGGTGAAGTATGAGGGCCACTGGCGGCAGGTGTGTGACCAGGGCTGGA
CCATGAACAACAGCAGGGTGGTGTGCGGGATGCTGGGCTTCCCCAGCGAGGTGCCTGTCGACAGCCACTACTACA
GGCTGAAGAGCCTGACGAATAAGAACTCCTTCTGGATCCACCAGGTCACCTGCCTGGGGACAGAGCCCCACATGG
CCAACTGCCAGGTGCAGGTGGCTCCAGCCCGGGGCAAGCTGCGGCCAGCCTGCCCAGGTGGCATGCACGCTGTGG
TCAGCTGTGTGGCAGGGCCTCACTTCCGCCCACCGAAGACAAAGCCACAACGCAAAGGGTCCTGGGCAGAGGAGC
CGAGGGTGCGCCTGCGCTCCGGGGCCCAGGTGGGCGAGGGCCGGGTGGAAGTGCTCATGAACCGCCAGTGGGGCA
CGGTCTGTGACCACAGGTGGAACCTCATCTCTGCCAGTGTCGTGTGTCGTCAGCTGGGCTTTGGCTCTGCTCGGG
AGGCCCTCTTTGGGGCCCGGCTGGGCCAAGGGCTAGGGCCCATCCACCTGAGTGAGGTGCGCTGCAGGGGATATG
AGCGGACCCTCAGCGACTGCCCTGCCCTGGAAGGGTCCCAGAATGGTTGCCAACATGAGAATGATGCTGCTGTCA
GGTGCAATGTCCCTAACATGGGCTTTCAGAATCAGGTGCGCTTGGCTGGTGGGCGTATCCCTGAGGAGGGGCTAT
TGGAGGTGCAGGTGGAGGTGAACGGGGTCCCACGCTGGGGGAGCGTGTGCAGTGAAAACTGGGGGCTCACCGAAG
CCATGGTGGCCTGCCGACAGCTCGGCCTGGGTTTTGCCATCCATGCCTACAAGGAAACCTGGTTCTGGTCGGGGA
CGCCAAGGGCCCAGGAGGTGGTGATGAGTGGGGTGCGCTGCTCAGGCACAGAGCTGGCCCTGCAGCAGTGCCAGA
GGCACGGGCCGGTGCACTGCTCCCACGGTGGCGGGCGCTTCCTGGCTGGAGTCTCCTGCATGGACAGTGCACCAG
ACCTGGTGATGAACGCCCAGCTAGTGCAGGAGACGGCCTACTTGGAGGACCGCCCGCTCAGCCAGCTGTATTGTG
CCCACGAGGAGAACTGCCTCTCCAAGTCTGCGGATCACATGGACTGGCCCTACGGATACCGCCGCCTATTGCGCT
TCTCCACACAGATCTACAATCTGGGCCGGACTGACTTTCGTCCAAAGACTGGACGCGATAGCTGGGTTTGGCACC
AGTGCCACAGGCATTACCACAGCATTGAGGTCTTCACCCACTACGACCTCCTCACTCTCAATGGCTCCAAGGTGG
CTGAGGGGCACAAGGCCAGCTTCGTGTCTGGAGGACACAAACTGCCCCACAGGACTGCAGCGGCGCTACGCATGTG
CCAACTTTGGAGAACAGGGAGTGACTGTAGGCTGCTGGGACACCTACCGGCATGACATTGATTGCCAGTGGGTGG
ATATCACAGATGTGGGCCCCGGGAATTATATCTTCCAGGTGATTGTGAACCCCCACTATGAAGTGGCAGAGTCAG
ATTTCTCCAACAATATGCTGCAGTGCCGCTGCAAGTATGATGGGCACCGGGTCTGGCTGCACAACTGCCACACAG
GTGAATTCATACCCAGCCAATGCAGAACTCTCCCTGGAGCAGGAACAGCGTCTCAGGAACAACCTCATCTGAAGC
TGTCACTGCACACTCCTAGCTGCTGCCGATACACCAGATACCTCAGCTTATTGGAGCCATGCCCTTCACAGAGTC
CCAACTCAGAGGAAAAGGGCCAGTGCCAAGGGGCACCAAGAACCTGCTCAGGAAGCCTTTTGATGGCAAGATCAC
CAATCCAGATGGTATTGCTCCCTCAGGATGGCTCTGGGCCTGCCCCTAAGGGCCTGTGGCCTATGGAATATGTCC
TCCAGGCTTTGCTCAGCTGAGCTCCTCTTCTGTAAGGAAACCCAGTCAT

TABLE 11B

Encoded NOV11a Protein Sequence (SEQ ID NO:32)

MAWSPPATLFLFLLLLGQPPPSRPQSLGTTKLRLVGPESKPEEGRLEVLHQGQWGTVCDDNFAIQEATVACRQLG
FEAALTWAHSAKYGQGEGPIWLDNVRCVGTESSLDQCGSNGWGVSDCSHSEDVGVICHPRRHRGYLSETVSNALG
PQVRRLGRRLEEVRLKPILASAKQHSPVTEGAVEVKYEGHWRQVCDQGWTMNNSRVVCGMLGFPSEVPVDSHYYR
LKSLTNKNSFWIHQVTCLGTEPHMANCQVQVAPARGKLRPACPGGMHAVVSCVAGPHFRPPKTKPQRKGSWAEEP
RVRLRSGAQVGEGRVEVLMNRQWGTVCDHRWNLISASVVCRQLGFGSAREALFGARLGQGLGPIHLSEVRCRGYE
RTLSDCPALEGSQNGCQHENDAAVRCNVPNMGFQNQVRLAGGRIPEEGLLEVQVEVNGVPRWGSVCSENWGLTEA
MVACRQLGLGFAIHAYKETWFWSGTPRAQEVVMSGVRCSGTELALQQCQRHGPVHCSNGGGRFLAGVSCMDSAPD
LVMNAQLVQETAYLEDRPLSQLYCAHEENCLSKSADHMDWPYGYRRLLRFSTQIYNLGRTDFRPKTGRDSWVWHQ
CHRHYHSIEVFTHYDLLTLNGSKVAEGHKASFCLEDTNCPTGLQRRYACANFGEQGVTVGCWDTYRHDIDCQWVD
ITDVGPGNYIFQVIVNPHYEVAESDFSNNMLQCRCKYDGHRVWLHNCHTGEFIPSQCRTLPGAGTASQEQPHLKL
SLHTPSCCRYTRYLSLLEPCPSQSPNSEEKGQCQGAPRTCSGSLLMARSPIQMVLLPQDGSGPAPKGLWPMEYVL
QALLS

SNP variants of NOV11a are disclosed in Example 2.

NOV11b

Alternatively, a NOV11 variant is NOV11b (alternatively referred to herein as CG56381-02), which includes the 2592 nucleotide sequence (SEQ ID NO:33) shown in Table 11C. An open reading frame for the mature protein was identified beginning with an ATG codon at nucleotides 46–48 and ending with a TGA codon at nucleotides 2314–2316. Putative untranslated regions, if any, downstream from the termination codon and upstream from the initiation codon are underlined. The start and stop codons are in bold letters.

The NOV11b protein (SEQ ID NO:34) encoded by SEQ ID NO:33 is 756 amino acid residues in length and is presented using the one-letter amino acid code in Table 11D. The SignalP, Psort and/or Hydropathy results indicate that NOV11b has a signal peptide and is likely to be localized in the lysosome (lumen) with a certainty of 0.4302. Alternatively, a NOV11b polypeptide is located extracellularly with a certainty of 0.3700, the microbody (peroxisome) with a certainty of 0.1403, or the endoplasmic reticulum (membrane) with a certainty of 0.1000. The SignalP indicates a likely cleavgae site for a NOV11b peptide between positions 24 and 25, i.e., at the dash in the sequence SRP-QS.

TABLE 11C

NOV11b Nucleotide Sequence (SEQ ID NO:33)

<u>CGCGCTCCATCTGGTATCTTGGCCTCAGCTGTCCTTGAAGTCACC</u>ATGGCGTGGTCCCCACCAGCCACCCTCTTT
CTGTTCCTGCTGCTGCTAGGCCAGCCCCCTCCCAGCAGGCCACAGTCACTGGGCACCACTAAGCTCCGGCTGGTG
GGCCCAGAGAGCAAGCCAGAGGAGGGCCGCCTGGAGGTGCTGCACCAGGGCCAGTGGGGCACCGTGTGTGATGAC
AACTTTGCTATCCAGGAGGCCACAGTGGCTTGCCGCCAGCTGGGCTTCGAAGCTGCCTTGACCTGGGCCCACAGT
GCCAAGTACGGCCAAGGGGAGGGACCCATCTGGCTGGACAATGTGCGCTGTGTGGGCACAGAGAGCTCCTTGGAC
CAGTGCGGGTCTAATGGCTGGGGAGTCAGTGACTGCAGTCACTCAGAAGACGTAGGGGTGATATGCCACCCCCGG
CGCCATCGTGGCTACCTTTCTGAAACTGTCTCCAATGCCCTTGGGCCCCAGGGCCAGCGGCTGGAGGAGGTGCGG
CTCAAGCCCATCCTTGCCAGTGCCAAGCAGCATAGCCCAGTGACCGAGGGAGCCGTGGAGGTGAAGTATGAGGGC
CACTGGCGGCAGGTGTGTGACCAGGGCTGGACCATGAACAACAGCAGGGTGGTGTGCGGGATGCTGGGCTTCCCC
AGCGAGGTGCCTGCCGACAGCCACTACTACAGGAAAGTCTGGGATCTGAAGATGAGGGACCCTAAGTCTAGGCTG
AAGAGCCTGACGAATAAGAACTCCTTCTGGATCCACCAGGTCACCTGCCTGGGGACAGAGCCCCACATGGCCAAC
TGCCAGGTGCAGGTGGCTCCAGCCCGGGGCAAGCTGCGGCCAGCCTGCCCAGGTGGCATGCACGCTGTGGTCAGC
TGTGTGGCAGGGCCTCACTTCCGCCCACCGAAGACAAAGCCACAACGCAAAGGGTCCTGGGCAGAGGAGCCGAGG
GTGCGCCTGCGCTCCGGGGCCCAGGTGGGCGAGGGCCGGGTGGAAGTGCTCATGAACCGCCAGTGGGGCACGGTC
TGTGACCACAGGTGGAACCTCATCTCTGCCAGTGTCGTGTGTCGTCAGCTGGGCTTTGGCTCTGCTCGGGAGGCC
CTCTTTGGGGCCCGGCTGGGCCAAGGGCTAGGGCCCATCCACCTGAGTGAGGTGCGCTGCAGGGGATATGAGCGG
ACCCTCAGCGACTGCCCTGCCCTGGAAGGGTCCCAGAATGGTTGCCAACATGAGAATGATGCTGCTGTCAGGTGC
AATGTCCCTAACATGGGCTTTCAGAATCAGGTGCGCTTGGCTGGTGGGCGTATCCCTGAGGAGGGGCTATTGGAG
GTGCAGGTGGAGGTGAACGGGGTCCCACGCTGGGGGAGCGTGTGCAGTGAAAACTGGGGGCTCACCGAAGCCATG
GTGGCCTGCCGACAGCTCGGCCTGGGTTTTGCCATCCATGCCTACAAGGAAACCTGGTTCTGGTCGGGGACGCCA
AGGGCCCAGGAGGTGGTGATGAGTGGGGTGCGCTGCTCAGGCACAGGCTGCCCTGCAGCAGTGCCAGAGGCAC
GGGCCGGTGCACTGCTCCCACGGTGGCGGGCGCTTCCTGGCTGGAGTCTCCTGCATGGACAGTGCACCAGACCTG
GTGATGAACGCCCAGCTAGTGCAGGAGACGGCCTACTTGGAGGACCGCCCGCTCAGCCAGCTGTATTGTGCCCAC
GAGGAGAACTGCCTCTCCAAGTCTGCGGATCACATGGACTGGCCCTACGGATACCGCCGCCTATTGCGCTTCTCC
ACACAGATCTACAATCTGGGCCGGACTGACTTTCGTCCAAAGACTGGACGCGATAGCTGGGTTTGGCACCAGTGT
CACAGGCATTACCACAGCATTGAGGTCTTCACCCACTACGACCTCCTCACTCTCAATGGCTCCAAGGTGGCTGAG
GGGCACAAGGCCAGCTTCTGTCTGGAGGACACAAACTGCCCCACAGGACTGCAGCGGCGCTACGCATGTGCCAAC
TTTGGAGAACAGGGAGTGACTGTAGGCTGCTGGGACACCTACCGGCATGACATTGATTGCCAGTGGGTGGATATC
ACAGATGTGGGCCCCGGGAATTATATCTTCCAGGTGATTGTGAATCCCCACTATGAAGTGGCAGAGTCAGATTTC
TCCAACAATATGCTGCAGTGCCGCTGCAAGTATGATGGGCACCGGGTCTGGCTGCACAACTGCCACACAGGGAAT
TCATACCCAGCCAATGCAGAACTCTCCCTGGAGCAGGAACAGCGTCTCAGGAACAACCTCATCTGA<u>AGCTGTCAC
TGCACACTCCTAGCTGCTGCCGATACACCAGATACCTCAGCTTATTGGAGCCATGCCCTTCACAGAGTCCCAACT
CAGAGGAAAAGGGCCAGTGCCAAGGGGCACCAAGAACCTGCTCAGGAAGCCTTTTGATGGCAAGATCACCAATCC
AGATGGTATTGCTCCCTCAGGATGGCTCTGGGCCTGCCCCTAAGGGCCTGTGGCCTATGGAATATGTCCTCCAGG
CTTTGCTTAGCTGAGCTCCCCTTCTGTAAGGAAACCCAGTCA</u>

TABLE 11D

Encoded NOV11b Protein Sequence (SEQ ID NO:34)

MAWSPPATLFLFLLLLGQPPPSRPQSLGTTKLRLVGPESKPEEGRLEVLHQGQWGTVCDDNFAIQEATVACRQLG
FEAALTWAHSAKYGQGEGPIWLDNVRCVGTESSLDQCGSNGWGVSDCSHSEDVGVICHPRRHRGYLSETVSNALG
PQGQRLEEVRLKPILASAKQHSPVTEGAVEVKYEGHWRQVCDQGWTMNNSRVVCGMLGFPSEVPADSHYYRKVWD
LKMRDPKSRLKSLTNKNSFWIHQVTCLGTEPHMANCQVQVAPARGKLRPACPGGMHAVVSCVAGPHFRPPKTKPQ
RKGSWAEEPRVRLRSGAQVGEGRVEVLMNRQWGTVCDHRWNLISASVVCRQLGFGSAREALFGARLGQGLGPIHL
SEVRCRGYERTLSDCPALEGSQNGCQHENDAAVRCNVPNMGFQNQVRLAGGRIPEEGLLEVQVEVNGVPRWGSVC
SENWGLTEAMVACRQLGLGFAIHAYKETWFWSGTPRAQEVVMSGVRCSGTELALQQCQRHGPVHCSHGGGRFLAG
VSCMDSAPDLVMNAQLVQETAYLEDRPLSQLYCAHEENCLSKSADHMDWPYGYRRLLRFSTQIYNLGRTDFRPKT
GRDSWVVWHQCHRHYHSIEVFTHYDLLTLNGSKVAEGHKASFCLEDTNCPTGLQRRYACANFGEQGVTVGCWDTYR
HDIDCQWVDITDVGPGNYIFQVIVNPHYEVAESDFSNNMLQCRCKYDGHRVWLHNCHTGNSYPANAELSLEQEQR
LRNNLI

NOV11 Clones

Unless specifically addressed as NOV11a or NOV11b, any reference to NOV11 is assumed to encompass all variants.

A search against the Patp database, a proprietary database that contains sequences published in patents and patent publication, yielded several homologous proteins shown in Table 11E.

TABLE 11E

PatP Results for NOV11

| Sequences Producing High-Scoring Segment Pairs: | High Score | Smallest Sum Prob P(N) |
|---|---|---|
| patp:AAB19127 Polypeptide isolated from lymph node stromal cells of fsn -/- mice | 3450 | 0.0 |
| patp:AAB49534 Clone HOHEC84 #1 - *Homo sapiens* | 2947 | 6.4e−307 |
| patp:AAB00077 Human lysyl oxidase related protein (Lor) | 2281 | 2.4e−236 |
| patp:AAB00073 Human lysyl oxidase related protein (Lor)-2 | 2279 | 3.9e−236 |
| patp:AAE11935 Human CG153 (or C593) receptor protein variant #2 | 2265 | 1.2e−234 |

In a BLAST search of public sequence databases, it was found, for example, that the NOV11a nucleic acid sequence of this invention has 1075 of 1078 bases (99%) identical to a gb:GENBANK-ID:AK025542|acc:AK025542.1 mRNA from *Homo sapiens* cDNA: FLJ21889 fis, clone HEP03178. Further, the full amino acid sequence of the disclosed NOV11a protein of the invention has 404 of 705 amino acid residues (57%) identical to, and 523 of 705 amino acid residues (74%) similar to, the 774 amino acid residue ptnr:SPTREMBL-ACC:Q9Y4K0 protein from Human (LYSYL OXIDASE-RELATED PROTEIN).

In a similar BLAST search of public sequence databases, it was found, for example, that the NOV11b nucleic acid sequence of this invention has 1070 of 1076 bases (99%) identical to a gb:GENBANK-ID:AK025542|acc:AK025542.1 mRNA from *Homo sapiens* cDNA: FLJ21889 fis, clone HEP03178. Further, the full amino acid sequence of the disclosed NOV11b protein of the invention has 360 of 616 amino acid residues (58%) identical to, and 456 of 616 amino acid residues (74%) similar to, the 895 amino acid residue ptnr:SPTREMBL-ACC:Q9W6N1 protein from *Perca flavescens* (Yellow perch) (LYSYL OXIDASE RELATED PROTEIN HOMOLOG).

Additional BLAST results are shown in Table 11F.

TABLE 11F

NOV11 BLASTP Results

| Gene Index/ Identifier | Protein/Organism | Length of aa | Identity (%) | Positives (%) | Expect Value |
|---|---|---|---|---|---|
| Q96JB6 | LYSYL OXIDASE-RELATED PROTEIN C - *Homo sapiens* (Human) | 756 | 722/739 (97%) | 723/739 (97%) | 0.0 |
| Q96PC0 | LYSYL OXIDASE-LIKE 4 - *Homo sapiens* (Human) | 756 | 718/739 (97%) | 720/739 (97%) | 0.0 |
| Q96DY1 | UNKNOWN (PROTEIN FOR MGC:17373) - *Homo sapiens* (Human) | 756 | 719/739 (97%) | 721/739 (97%) | 0.0 |

TABLE 11F-continued

NOV11 BLASTP Results

| Gene Index/ Identifier | Protein/Organism | Length of aa | Identity (%) | Positives (%) | Expect Value |
|---|---|---|---|---|---|
| Q924C6 | LYSYL OXIDASE-RELATED PROTEIN C - *Mus musculus* (Mouse) | 757 | 624/736 (84%) | 665/736 (90%) | 0.0 |
| Q9Y4K0 | Lysyl oxidase homolog 2 precursor (EC 1.4.3.-) (Lysyl oxidase-like protein 2) (Lysyl oxidase related protein 2) (Lysyl oxidase-related protein WS9-14) - *Homo sapiens* (Human) | 774 | 404/705 (57%) | 523/705 (74%) | 3.1e−236 |

A multiple sequence alignment is given in Table 11G, with the NOV11 proteins of the invention being shown in lines 1 and 2 in a ClustalW analysis comparing NOV11 with related protein sequences of Table 11F.

Table 11G. ClustalW Analysis of NOV11

1. SEQ ID NO.: 32 NOV11a
2. SEQ ID NO.: 34 NOV11b
3. SEQ ID NO.: 187 Q96JB6
4. SEQ ID NO.: 188 Q96PC0
5. SEQ ID NO.: 189 Q96DY1
6. SEQ ID NO.: 190 Q924C6
7. SEQ ID NO.: 191 Q9Y4K0

```
                    10        20        30        40        50        60
             ....|....|....|....|....|....|....|....|....|....|....|....|
NOV11a       MAWSPPATLFLFLLLLG-QPP----------------------PSRPQSLGTTKLRL   34
NOV11b       MAWSPPATLFLFLLLLG-QPP----------------------PSRPQSLGTTKLRL   34
Q96JB6       MAWSPPATLFLFLLLLG-QPP----------------------PSRPQSLGTTKLRL   34
Q96PC0       MAWSPPATLFLFLLLLG-QPP----------------------PSRPQSLGTTKLRL   34
Q96DY1       MARSPPATLFLFLLLLG-QPP----------------------PSRPQSLGTTKLRL   34
Q924C6       MMWPQPPTFSLFLLLLLSQAP----------------------SSRPQSSGTKKLRL   35
Q9Y4K0       MERPLCSHLCSCLAMLALLSPLSLAQYDSWPHYPEYFQQPAPEYHQPQAPANVAKIQLRL   60

70        80        90       100       110       120
             ....|....|....|....|....|....|....|....|....|....|....|....|
NOV11a       VGPESKPEEGRLEVLHQGQWGTVCDDNFAIQEATVACRQLGFEAALTWAHSAKYGQGEGP   94
NOV11b       VGPESKPEEGRLEVLHQGQWGTVCDDNFAIQEATVACRQLGFEAALTWAHSAKYGQGEGP   94
Q96JB6       VGPESKPEEGRLEVLHQGQWGTVCDDNFAIQEATVACRQLGFEAALTWAHSAKYGQGEGP   94
Q96PC0       VGPESKPEEGRLEVLHQGQWGTVCDDNFAIQEATVACRQLGFEAALTWAHSAKYGQGEGP   94
Q96DY1       VGPESKPEEGRLEVLHQGQWGTVCDDNFAIQEATVACRQLGFESALTWAHSAKYGQGEGP   94
Q924C6       VGPADRPEEGRLEVLHQGQWGTVCDDDFAIQEATVACRQLGFESALTWAHSAKYGQGEGP   95
Q9Y4K0       AGQKRKHSEGRVEVYYDGQWGTVCDDDFSIHAAHVVCRELGYVEAKSWTASSSYGKGEGP  120

130       140       150       160       170       180
             ....|....|....|....|....|....|....|....|....|....|....|....|
NOV11a       IWLDNVRCVGTESSLDQCGSNGWGVSDCSHSEDVGVICHPRRHRGYLSETVSNALGPQVR  154
NOV11b       IWLDNVRCVGTESSLDQCGSNGWGVSDCSHSEDVGVICHPRRHRGYLSETVSNALGPQ--  152
Q96JB6       IWLDNVRCVGTESSLDQCGSNGWGVSDCSHSEDVGVICHPRRHRGYLSETVSNALGPQ--  152
Q96PC0       IWLDNVRCVGTESSLDQCGSNGWGVSDCSHSEDVGVICHPRRHRGYLSETVSNALGPQ--  152
Q96DY1       IWLDNVQCVGTESSLDQCGSNGWGVSDCSHSEDVGVICHPRRHRGYLSETVSNALGPQ--  152
Q924C6       IWLDNVRCLGTEKTLDQCGSNGWGISDCRHSEDVGVVCHPRRQHGYHSEKVSNALGPQ--  153
Q9Y4K0       IWLDNLHCTGNEATLAACTSNGWGVTDCKHTEDVGVVCSDKRIPGEK---FDNSLINQIE  177

190       200       210       220       230       240
```

163                                           164

```
            ....|....|....|....|....|....|....|....|....|....|....|....|
NOV11a   RLGRRLEEVRLKPILASAKQHSPVTEGAVEVKYEGHWRQVCDQGWTMNNSRVVCGMLGFP   214
NOV11b   --GQRLEEVRLKPILASAKQHSPVTEGAVEVKYEGHWRQVCDQGWTMNNSRVVCGMLGFP   210
Q96JB6   --GRRLEEVRLKPILASAKQHSPVTEGAVEVKYEGHWRQVCDQGWTMNNSRVVCGMLGFP   210
Q96PC0   --GRRLEEVRLKPILASAKQHSPVTEGAVEVKYEGHWRQVCDQGWTMNNSRVVCGMLGFP   210
Q96DY1   --GRRLEEVRLKPILASAKQHSPVTEGAVEVKYEGHWRQVCDQGWTMNNSRVVCGMLGFP   210
Q924C6   --GRRLEEVRLKPILASAKRHSPVTEGAVEVRYDGHWRQVCDQGWTMNNSRVVCGMLGFP   211
Q9Y4K0   NLNIQVEDIRLRAILSTYRKRIPVMEGYVEVKEGKTWKQICDKHWTAKNSRVVCGMFGFP   237
```

```
                250       260       270       280       290       300
            ....|....|....|....|....|....|....|....|....|....|....|....|
NOV11a   SEVPVDSHYYR--------------LKSLTNKNSFWIHQVTCLGTEPHMANCQVQVAPARG   261
NOV11b   SEVPADSHYYRKVWDLKMRDPKSRLKSLTNKNSFWIHQVTCLGTEPHMANCQVQVAPARG   270
Q96JB6   SEVPVDSHYYRKVWDLKMRDPKSRLKSLTNKNSFWIHQVTCLGTEPHMANCQVQVAPARG   270
Q96PC0   SEVPVDSHYYRKVWDLKMRDPKSRLKSLTNKNSFWIHQVTCLGTEPHMANCQVQVAPARG   270
Q96DY1   SEVPVDSHYYRKVWDLKMRDPKSRLKSLTNKNSFWIHQVTCLGTEPHMANCQVQVAPARG   270
Q924C6   SQTSVNSHYYRKVWNLKMKDPKSRLNSLTKKNSFWIHRVDCFGTEPHLAKCQVQVAPGRG   271
Q9Y4K0   GERTYNTKVYK---------MFASRR-KQRYWPFSMDCTGTEAHISSCKLGPQVSLD    284
```

```
                310       320       330       340       350       360
            ....|....|....|....|....|....|....|....|....|....|....|....|
NOV11a   KLR-PACPGGMHAVVSCVAGPHFRPPKTKPQRKGSWAEEPRVRLRSGAQVGEGRVEVLMN   320
NOV11b   KLR-PACPGGMHAVVSCVAGPHFRPPKTKPQRKGSWAEEPRVRLRSGAQVGEGRVEVLMN   329
Q96JB6   KLR-PACPGGMHAVVSCVAGPHFRPPKTKPQRKGSWAEEPRVRLRSGAQVGEGRVEVLMN   329
Q96PC0   KLR-PACPGGMHAVVSCVAGPHFRPPKTKPQRKGSWAEEPRVRLRSGAQVGEGRVEVLMN   329
Q96DY1   KLR-PACPGGMHAVVSCVAGPHFRPPKTKPQRKGSWAEEPRVRLRSGAQVGEGRVEVLMN   329
Q924C6   KLR-PACPGGMHAVVSCVAGPHFRRQKPKPTRKESHAEELKVRLRSGAQVGEGRVEVLMN   330
Q9Y4K0   PMKNVTCENGLPAVVSCVPGQVFSPDGPSRFRKAYKPEQPLVRLRGGAYIGEGRVEVLKN   344
```

```
                370       380       390       400       410       420
            ....|....|....|....|....|....|....|....|....|....|....|....|
NOV11a   RQWGTVCDHRWNLISASVVCRQLGFGSAREALFGARLGQGLGPIHLSEVRCRGYERTLSD   380
NOV11b   RQWGTVCDHRWNLISASVVCRQLGFGSAREALFGARLGQGLGPIHLSEVRCRGYERTLSD   389
Q96JB6   RQWGTVCDHRWNLISASVVCRQLGFGSAREALFGARLGQGLGPIHLSEVRCRGYERTLSD   389
Q96PC0   RQWGTVCDHRWNLISASVVCRQLGFGSAREALFGARLGQGLGPIHLSEVRCRGYERTLSD   389
Q96DY1   RQWGTVCDHRWNLISASVVCRQLGFGSAREALFGARLGQGLGPIHLSEVRCRGYERTLSD   389
Q924C6   RQWGTVCDHRWNLISASVVCRQLGFGSAREALFGAQLGQGLGPIHLNEVRCRGYERTLGD   390
Q9Y4K0   GEWGTVCDDKWDLVSASVVCRELGFGSAKEAVTGSRLGQCIGPIHLNEQCTGNEKSIID   404
```

```
                430       440       450       460       470       480
            ....|....|....|....|....|....|....|....|....|....|....|....|
NOV11a   CPALEGSQNGCQHENDAAVRCNVPNMGFQNQVRLAGGRIPEEGLLEVQVENGVPRWGSV   440
NOV11b   CPALEGSQNGCQHENDAAVRCNVPNMGFQNQVRLAGGRIPEEGLLEVQVENGVPRWGSV   449
Q96JB6   CPALEGSQNGCQHENDAAVRCNVPNMGFQNQVRLAGGRIPEEGLLEVQVENGVPRWGSV   449
Q96PC0   CPALEGSQNGCQHENDAAVRCNVPNMGFQNQVRLAGGRIPEEGLLEVQVENGVPRWGSV   449
Q96DY1   CPALEGSQNGCQHENAAAVRCNVPNMGFQNQVRLAGGRIPEEGLLEVQVENGVPRWGSV   449
Q924C6   CLALEGSQNGCQHANDAAVRCNIPDMGFQNKVRLAGGRNSEEGVVEVQVENGGPRWGTV   450
Q9Y4K0   CKFNAESQ-GCNHEEDAGVRCNTPAMGLQKKIRLNGGRNPYEGRVEVLVERNGSLVWGMV   463
```

```
                490       500       510       520       530       540
            ....|....|....|....|....|....|....|....|....|....|....|....|
NOV11a   CSENWGLTEAMVACRQLGLGFAIHAYKETWFWSGTPRAQEVVMSGVRCSGTELALQQCQR   500
NOV11b   CSENWGLTEAMVACRQLGLGFAIHAYKETWFWSGTPRAQEVVMSGVRCSGTELALQQCQR   509
Q96JB6   CSENWGLTEAMVACRQLGLGFAIHAYKETWFWSGTPRAQEVVMSGVRCSGTELALQQCQR   509
Q96PC0   CSENWGLTEAMVACRQLGLGFAIHAYKETWFWSGTPRAQEVVMGGVRCSGTELALQQCQR   509
Q96DY1   CSENWGLTEAMVACRQLGLGFAIHAYKETWFWSGTPRAQEVVMSGVRCSGTELALQQCQR   509
Q924C6   CSDHWGLTEAMVTCRQLGLGFANFALKDTWLWQGTPEAKEVVMSGVRCSGTEMALQQCQR   510
```

```
Q9Y4K0   CGQNWGIVEAMVVCRQLGLGFASNAFQETWYWHGDVNSNKVVMSGVKCSGTELSLAHCRH   523

550       560       570       580       590       600
         ....|....|....|....|....|....|....|....|....|....|....|....|
NOV11a   HG-PVHCSHGGGRFLAGVSCMDSAPDLVMNAQLVQETAYLEDRPLSQLYCAHEENCLSKS   559
NOV11b   HG-PVHCSHGGGRFLAGVSCMDSAPDLVMNAQLVQETAYLEDRPLSQLYCAHEENCLSKS   568
Q96JB6   HG-PVHCSHGGGRFLAGVSCMDSAPDLVMNAQLVQETAYLEDRPLSQLYCAHEENCLSKS   568
Q96PC0   HG-PVHCSHGGGRFLAGVSCMDSAPDLVMNTQLAQETAYLEDRPLSQLYCAHEENCLSKS   568
Q96DY1   HG-PVHCSHGGGRFLAGVSCMDSAPDLVMNAQLVQETAYLEDRPLSQLYCAHEENCLSKS   568
Q924C6   HG-PVHCSHGPGRFSAGVACMNSAPDLVMNAQLVQETAYLEDRPLSMLYCAHEENCLSKS   569
Q9Y4K0   DGEDVACPQGGVQYGAGVACSETAPDLVLNAEMVQTTYLEDRPMFMLQCAMEENCLSAS   583

610       620       630       640       650       660
         ....|....|....|....|....|....|....|....|....|....|....|....|
NOV11a   ADHMDWPYGYRRLLRFSTQIYNLGRTDFRPKTGRDSWVWHQCHRHYHSIEVFTHYDLLTL   619
NOV11b   ADHMDWPYGYRRLLRFSTQIYNLGRTDFRPKTGRDSWVWHQCHRHYHSIEVFTHYDLLTL   628
Q96JB6   ADHMDWPYGYRRLLRFSTQIYNLGRTDFRPKTGRDSWVWHQCHRHYHSIEVFTHYDLLTL   628
Q96PC0   ADHMDWPYGYRRLLRFSTQIYNLGRTDFRPKTGRDSWVWHQCHRHYHSIEVFTHYDLLTL   628
Q96DY1   ADHMDWPYGYRRLLRFSTQIYNLGRTDFRPKTGRDSWVWHQCHRHYHSIEVFTHYDLLTL   628
Q924C6   ADHMDWPYGYRRLLRFSSQIYNLGRADFRPKAGRHSWIWHQCHRHNHSIEVFTHYDLLTL   629
Q9Y4K0   AAQTDPTTGYRRLLRFSSQIFNNGQSDFRPKNGRHAWLWHDCHRHYHSMEVFTHYDLLNL   643

670       680       690       700       710       720
         ....|....|....|....|....|....|....|....|....|....|....|....|
NOV11a   NGSKVAEGHKASFCLEDTNCPTGLQRRYACANFGEQGVTVGCWDTYRHDIDCQWVDITDV   679
NOV11b   NGSKVAEGHKASFCLEDTNCPTGLQRRYACANFGEQGVTVGCWDTYRHDIDCQWVDITDV   688
Q96JB6   NGSKVAEGHKASFCLEDTNCPTGLQRRYACANFGEQGVTVGCWDTYRHDIDCQWVDITDV   688
Q96PC0   NGSKVAEGHKASFCLEDTNCPTGLQRRYACANFGEQGVTVGCWDTYRHDIDCQWVDITDV   688
Q96DY1   NGSKVAEGHKASFCLEDTNCPTGLQRRYACANFGEQGVTVGCWDTYRHDIDCQWVDITDV   688
Q924C6   NGSKVAEGHKASFCLEDTNCPSGVQRRYACANFGEQGVAVGCWDTYRHDIDCQWVDITDV   689
Q9Y4K0   NGTKVAEGHKASFCLEDTECEGDIQKNYECANFGDQGITMGCWDMYRHDIDCQWVDITDV   703

730       740       750       760       770       780
         ....|....|....|....|....|....|....|....|....|....|....|....|
NOV11a   GPGNYIFQVIVNPHYEVAESDFSNNMLQCRCKYDGHRVWLHNCHTGEFIPSQCRTLPGAG   739
NOV11b   GPGNYIFQVIVNPHYEVAESDFSNNMLQCRCKYDGHRVWLHNCHTGNSYP------ANAE   742
Q96JB6   GPGNYIFQVIVNPHYEVAESDFSNNMLQCRCKYDGHRVWLHNCHTGNSYP------ANAE   742
Q96PC0   GPGNYIFQVIVNPHYEVAESDFSNNMLQCRCKYDGHRVWLHNCHTGNSYP------ANAE   742
Q96DY1   GPGNYIFQVIVNPHYEVAESDFSNNMLQCRCKYDGHRVWLHNCHTGNSYP------ANAE   742
Q924C6   GPGDYIFQVVVNPTNDVAESDFSNNMLRCRCKYDGQRVWLHNCHTGDSYR------ANAE   743
Q9Y4K0   PPGDYIFQVVINPNEVAESDYSNNMMKCRSRYDGHRLWMYNCHIGGSFS------EETE   757

790       800       810       820       830       840
         ....|....|....|....|....|....|....|....|....|....|....|....|
NOV11a   TASQEQPHLKLSLHTPSCCRYTRYLSLLEPCPSQSPNSEEKGQCQGAPRTCSGSLLMARS   799
NOV11b   LSLEQEQRLRNNLI----------------------------------------------   756
Q96JB6   LSLEQEQRLRNNLI----------------------------------------------   756
Q96PC0   LSLEQEQRLRNNLI----------------------------------------------   756
Q96DY1   LSLEQEQRLRNNLI----------------------------------------------   756
Q924C6   LSLEQEQRLRNNLI----------------------------------------------   757
Q9Y4K0   KKFEHFSGLLNNQLSPQ-------------------------------------------   774

850       860       870
         ....|....|....|....|....|....|.
NOV11a   PIQMVLLPDGSGPAPKGLWPMEYVLQALLS   830
NOV11b   ------------------------------   756
Q96JB6   ------------------------------   756
```

```
Q96PC0   ------------------------------   756
Q96DY1   ------------------------------   756
Q924C6   ------------------------------   757
Q9Y4K0   ------------------------------   774
```

The presence of identifiable domains in the disclosed NOV11 protein was determined by using Pfam and then determining the Interpro number. The results are listed in Table 11H with the statistics and domain description.

TABLE 11H

Domain Analysis of NOV11

| PSSMs Producing Significant Alignments | Score (bits) | E Value |
|---|---|---|
| Lysyl_oxidase: domain 1 of 1, from 524 to 727 | 511.7 | 5.6e-150 |

```
LOX      pDLvldpalVQetaYvedrpLylLrCAaEEnCLaSsAyraeawdYdh
         +||+  +++||+++|+++++|   |+||  ||+||+ +|  ++ ++|+
NOV11    PDLVMNAQLVQETAYLEDRPLSQLYCAHEENCLSKSADHMD-WPYGY LOX      RrLLRFssrvkNlGrADFrPkapRhsWeWHsCHqHYHSmdeFtHYDLLda
         |+||||+ ++ |+|+ ||+|+ +| +|+||+||+|||+++|+||||++
NOV11    RRLLRFSTQIYNLGRTDFRPKTGRDSWVWHQCHRHYHSIEVFTHYDLLTL LOX      ngtkKVAEGHKASFCLEDteCdegvlkRYaCtnhGtQGlsvGCyDtYraD
         ++  |||||||||||||||+ |+ +  +||+|+++|+||+++||+|+|++|
NOV11    NGS-KVAEGHKASFCLEDTNCPTGLQRRYACANFGEQGVTVGCWDTYRHD LOX      IDCQWiDITDvkPGnYILkVevNPkyevaESDFtNNvvrCnikYdGhrvy
         |||||+||||+ ||+|++| +||  ++++|||||+||  ++|+++|+|+++
NOV11    IDCQWVDITDVGPGNYIFQVIVNPHYEVAESDFSNNMLQCRCKYDGHRVW LOX      asnChigda    (SEQ ID NO:192)
         ++|+ ++
NOV11    LHNCHTGEF    (SEQ ID NO:32)
```

Consistent with other known members of the copper-dependent amine oxidase family of proteins, NOV11 contains a lysyl oxidase domain as illustrated in Table 11H.

NOV11 nucleic acids, and the encoded polypeptides, according to the invention are useful in a variety of applications and contexts. For example, NOV11 nucleic acids and polypeptides can be used to identify proteins that are members of the copper-dependent amine oxidase family of proteins. The NOV11 nucleic acids and polypeptides can also be used to screen for molecules, which inhibit or enhance NOV11 activity or function. Specifically, the nucleic acids and polypeptides according to the invention may be used as targets for the identification of small molecules that modulate or inhibit, e.g., crosslinking of extracellular matrix proteins. These molecules can be used to treat, e.g., autoimmune disease, allergies, immunodeficiencies, asthma, psoriasis, acne, or pigmentation disorders.

In addition, various NOV11 nucleic acids and polypeptides according to the invention are useful, inter alia, as novel members of the protein families according to the presence of domains and sequence relatedness to previously described proteins. For example, the NOV11 nucleic acids and their encoded polypeptides include structural motifs that are characteristic of proteins belonging to the lysyl oxidase family. Lysyl oxidase (LOX) is a secreted enzyme that cross-links collagen and elastin, and thus is critical for the integrity of the extracellular matrix, the breakdown of which contributes to cancer invasion and metastasis. LOX is also important to the health of connective tissues and arteries. Lysyl oxidase requires a copper co-factor and therefore its activity can be lowered by a dietary deficiency.

The NOV11 nucleic acids and polypeptides, antibodies and related compounds according to the invention will be useful in therapeutic and diagnostic applications in the mediation of crosslinking and biogenesis of connective tissue matrices. As such the NOV11 nucleic acids and polypeptides, antibodies and related compounds according to the invention may be used to treat digestive disorders, e.g., diabetes, Von Hippel-Lindau (VHL) syndrome, pancreatitis, obesity, endometriosis, fertility, hemophilia, hypercoagulation, idiopathic thrombocytopenic purpura, autoimmune disease, allergies, immunodeficiencies, transplantation, graft versus host disease (GVHD), lymphaedema, osteoporosis, hypercalceimia, arthritis, ankylosing spondylitis, scoliosis, systemic lupus erythematosus, asthma, emphysema, scleroderma, allergy, ARDS, renal artery stenosis, interstitial nephritis, glomerulonephritis, polycystic kidney disease, systemic lupus erythematosus, renal tubular acidosis, IgA nephropathy, Lesch-Nyhan syndrome, psoriasis, actinic keratosis, tuberous sclerosis, acne, hair growth/loss, alopecia, pigmentation disorders, and endocrine disorders.

The NOV11 nucleic acids and polypeptides are useful for detecting specific cell types. For example, expression analysis has demonstrated that a NOV11 nucleic acid is expressed in kidney, lung, lymphoid tissue, mammary gland/breast, ovary, pancreas, testis, uterus, and bone.

Additional utilities for NOV11 nucleic acids and polypeptides according to the invention are disclosed herein.

NOV12

The NOV12 proteins descibed herein are novel phosphatase-like proteins. The NOV12 nucleic acids disclosed herein map to chromosome 17. Two alternative novel NOV12 nucleic acids and polypeptides are disclosed herein, namely NOV12a and NOV12b.

NOV12a

A NOV12 variant is NOV12a (alternatively referred to herein as CG56436-01), which encodes the 1002 nucleotide sequence (SEQ ID NO:35) shown in Table 12A. An open reading frame for the mature protein was identified beginning with an ATG codon at nucleotides 101–103 and ending with a TGA codon at nucleotides 902–904. Putative untranslated regions, if any, downstream from the termination codon and upstream from the initiation codon are underlined. The start and stop codons are in bold letters.

TABLE 12A

NOV12a Nucleotide Sequence (SEQ ID NO:35)

<u>GCCGGGACAGACCTCTGCTGCCGCCGCCCCCACGAACGTGTGACGACGGCTGGAGGCCAACAGAGTCCCTACAGG
TGGTGCTCACGGTAATGCACCGACA</u>ATGAGTGGCTGTTTTCCAGTTTCTGGCCTCCGCTGCCTATCTAGGGACGG
CAGGATGGCCGCGCAGGGCGCGCCGCGCTTCCTCCTGACCTTCGACTTCGACGAGACTATCGTGGACGAAAACAG
CGACGATTCGATCGTGCGCGCCGCGCCGGGCCAGCGGCTCCCGGAGAGCCTGCGAGCCACCTACCGCGAGGGCTT
CTACAACGAGTACATGCAGCGCGTCTTCAAGTACCTGGGCGAGCAGGGCGTGCGGCCGCGGGACCTGAGCGCCAT
CTACGAAGCCATCCCTTTGTCGCCAGGCATGAGCGACCTGCTGCAGTTTGTGGCAAAACAGGGCGCCTGCTTCGA
GGTGATTCTCATCTCCGATGCCAACACCTTTGGCGTGGAGAGCTCGCTGCGCGCCGCCGGCCACCACAGCCTGTT
CCGCCGCATCCTCAGCAACCCGTCGGGGCCGGATGCGCGGGGACTGCTGGCTCTGCGGCCGTTCCACACACACAG
CTGCGCGCGCTGCCCCGCCAACATGTGCAAGCACAAGGTGCTCAGCGACTACCTGCGCGAGCGGGCCCACGACGG
CGTGCACTTCGAGCGCCTCTTCTACGTGGGCGACGGCGCCAACGACTTCTGCCCCATGGGGCTGCTGGCGGGCGG
CGACGTGGCCTTCCCGCGCCGCGGCTACCCCATGCACCGCCTCATTCAGGAGGCCCAGAAGGCCGAGCCCAGCTC
GTTCCGCGCCAGCGTGGTGCCCTGGGAAACGGCTGCAGATGTGCGCCTCCACCTGCAACAGGTGCTGAAGTCGTG
CTGA<u>GTCTGGCCGCCTGCAGGGGGGTACCCGGGCCAACGGCGGAGGGGGCGGGGAAGGGAGATTCGGCAAAGACA
GCTTTACTACTCCCTTTTCCCTTTGGC</u>

The NOV12a protein (SEQ ID NO:36) encoded by SEQ ID NO:35 is 267 amino acid residues in length and is presented using the one-letter amino acid code in Table 12B. The SignalP, Psort and/or Hydropathy results indicate that NOV12a has no known signal peptide and is likely to be localized in the mitochondrial matrix space with a certainty of 0.4728. Alternatively, a NOV12a polypeptide is located in the microbody (peroxisome) with a certainty of 0.2224, the lysosome (lumen) with a certainty of 0.1905, or the mitochondrial inner membrane with a certainty of 0.1762.

The NOV12b protein (SEQ ID NO:38) encoded by SEQ ID NO:37 is 267 amino acid residues in length and is presented using the one-letter amino acid code in Table 12D. The SignalP, Psort and/or Hydropathy results predict that NOV12b has no known signal peptide and is likely to be localized in the mitochondrial matrix space with a certainty of 0.4728. Alternatively, a NOV12b polypeptide is located in the microbody (peroxisome) with a certainty of 0.2224, the lysosome (lumen) with a certainty of 0.1905, or the mitochondrial inner membrane with a certainty of 0.1762.

TABLE 12B

Encoded NOV12a Protein Sequence (SEQ ID NO:36)

MSGCFPVSGLRCLSRDGRMAAQGAPRFLLTFDFDETIVDENSDDSIVRAAPGQRLPESLRATYREGFYNEYMQRV
FKYLGEQGVRPRDLSAIYEAIPLSPGMSDLLQFVAKQGACFEVILISDANTFGVESSLRAAGHHSLFRRILSNPS
GPDARGLLALRPFHTHSCARCPANMCKHKVLSDYLRERAHDGVHFERLFYVGDGANDFCPMGLLAGGDVAFPRRG
YPMHRLIQEAQKAEPSSFRASVVPWETAADVRLHLQQVLKSC

SNP variants of NOV12a are disclosed in Example 2.

NOV12b

Alternatively, a NOV12 variant is NOV12b (alternatively referred to herein as CG5643602), which includes the 903 nucleotide sequence (SEQ ID NO:37) shown in Table 12C. An open reading frame for the mature protein was identified beginning with an ATG codon at nucleotides 4–6 and ending with a TGA codon at nucleotides 805–807. Putative untranslated regions, if any, downstream from the termination codon and upstream from the initiation codon are underlined. The start and stop codons are in bold letters.

TABLE 12C

NOV12b Nucleotide Sequence (SEQ ID NO:37)

<u>ACA</u>ATGAGTGGCTGTTTTCCAGTTTCTGGCCTCCGCTGCCTATCTAGGGACGGCAGGATGGCCGCGCAGGGCGCG
CCGCGCTTCCTCCTGACCTTCGACTTCGACGAGACTATCGTGGACGAAAACAGCGACGATTCGATCGTGCGCGCC
GCGCCGGGCCAGCGGCTCCCGGAGAGCCTGCGAGCCACCTACCGCGAGGGCTTCTACAACGAGTACATGCAGCGC
GTCTTCAAGTACCTGGGCGAGCAGGGCGTGCGGCCGCGGGACCTGAGCGCCATCTACGAAGCCATCCCTTTGTCG
CCACGCATGAGCGACCTGCTGCAGTTTGTGGCAAAACAGGGCGCCTGCTTCGAGGTGATTCTCATCTCCGATGCC
AACACCTTTGGCGTGGAGAGCTCGCTGCGCGCCGCCGGCCACCACAGCCTGTTCCGCCGCATCCTCAGCAACCCG
TCGGGGCCGGATGCGCGGGGACTGCTGGCTCTGCGGCCGTTCCACACACACAGCTGCGCGCGCTGCCCCGCCAAC
ATGTGCAAGCACAAGGTGCTCAGCGACTACCTCCGCGAGCGGGCCCACGACGGCGTGCACTTCGAGCGCCTCTTC
TACGTGGGCGACGGCGCCAACGACTTCTGCCCCATGGGGCTGCTGGCGGGCGGCGACGTGGCCTTCCCGCGCCGC
GGCTACCCCATGCACCGCCTCATTCAGGAGGCCCAGAAGGCCGAGCCCAGCTCGTTCCGCGCCAGCGTGGTGCCC
TGGGAAACGGCTGCAGATGTGCGCCTCCACCTGCAACAGGTGCTGAAGTCGTGCTGA<u>GTCTGGCCGCCTGCAGGG
GGGTACCCGGGCCAACGGCGGAGGGGGCGGGGAAGGGAGATTCGGCAAAGACAGCTTTACTACTCCCTTTTCCCT
TTG</u>

TABLE 12D

Encoded NOV12b Protein Sequence (SEQ ID NO:38)

MSGCFPVSGLRCLSRDGRMAAQGAPRFLLTFDFDETIVDENSDDSIVRAAPGQRLPESLRATYREGFYNEYMQRV
FKYLGEQGVRPRDLSAIYEAIPLSPGMSDLLQFVAKQGACFEVILISDANTFGVESSLPAAGHHSLFRRILSNPS
GPDARGLLALRPFHTHSCARCPANMCKHKVLSDYLRERAIDGVHFERLFYVGDGANDFCPMGLLAGGDVAFPRRG
YPMHRLIQEAQKAEPSSFRASVVPWETAADVRLHLQQVLKSC

NOV12 Clones

Unless specifically addressed as NOV12a or NOV12b, any reference to NOV12 is assumed to encompass all variants.

A search against the Patp database, a proprietary database that contains sequences published in patents and patent publication, yielded several homologous proteins shown in Table 12E.

TABLE 12E

PatP Results for NOV12

| Sequences Producing High-Scoring Segment Pairs: | High Score | Smallest Sum Prob P(N) |
|---|---|---|
| patp:AAB42487 Human ORFX ORF2251 polypeptide sequence | 1409 | 6.1e−144 |
| patp:AAB52146 Human secreted protein encoded by cDNA #44 | 738 | 7.7e−73 |
| patp:AAB52178 Human secreted protein BLAST search protein | 706 | 1.9e−69 |
| patp:AAB52177 Human secreted protein BLAST search protein | 475 | 5.7e−45 |
| patp:AAM93066 Human digestive system antigen | 347 | 2.1e−31 |

In a BLAST search of public sequence databases, it was found, for example, that the NOV12a nucleic acid sequence of this invention has 609 of 916 bases (66%) identical to a gb:GENBANK-ID:GGA6529|acc:AJ006529.1 mRNA from *Gallus gallus* (*Gallus gallus* mRNA for putative phosphatase). Further, the full amino acid sequence of the disclosed NOV12a protein of the invention has 159 of 265 amino acid residues (60%) identical to, and 199 of 265 amino acid residues (75%) similar to, the 268 amino acid residue ptnr:SPTREMBL-ACC:O73884 protein from *Gallus gallus* (Chicken) (PUTATIVE PHOSPHATASE).

In a similar BLAST search of public sequence databases, it was found, for example, that the NOV12b nucleic acid sequence of this invention has 579 of 865 bases (66%) identical to a gb:GENBANK-ID:GGA6529|acc:AJ006529.1 mRNA from *Gallus gallus* (*Gallus gallus* mRNA for putative phosphatase). Further, the full amino acid sequence of the disclosed NOV12b protein of the invention has 159 of 265 amino acid residues (60%) identical to, and 199 of 265 amino acid residues (75%) similar to, the 268 amino acid residue ptnr:SPTREMBL-ACC:O73884 protein from *Gallus gallus* (Chicken) (PUTATIVE PHOSPHATASE).

Additional BLAST results are shown in Table 12F.

TABLE 12F

NOV12 BLASTP Results

| Gene Index/ Identifier | Protein/Organism | Length of aa | Identity (%) | Positives (%) | Expect Value |
|---|---|---|---|---|---|
| O73884 | PUTATIVE PHOSPHATASE - *Gallus gallus* (Chicken) | 268 | 159/265 (60%) | 199/265 (75%) | 2.1e−86 |
| Q9D9M5 | 1700048E23RIK PROTEIN - *Mus musculus* (Mouse) | 241 | 98/240 (40%) | 154/240 (64%) | 1.2e−51 |
| Q9VWF0 | CG12237 PROTEIN (LP01149P) - *Drosophila melanogaster* (Fruit fly) | 306 | 75/231 (32%) | 120/231 (51%) | 7.6e−27 |
| Q9SU92 | HYPOTHETICAL 28.1 KDA PROTEIN - *Arabidopsis thaliana* (Mouse-ear cress) | 245 | 79/238 (33%) | 123/238 (51%) | 6.8e−26 |
| Q9FZ62 | F11A6.5 PROTEIN - *Arabidopsis thaliana* (Mouse-ear cress) | 279 | 74/237 (31%) | 121/237 (51%) | 8.7e−26 |

A multiple sequence alignment is given in Table 12G, with the NOV12 proteins of the invention being shown in lines 1 and 2 in a ClustalW analysis comparing NOV12 with related protein sequences of Table 12F.

Table 12G. ClustalW Analysis of NOV12

1. SEQ ID NO.: 36   NOV12a
2. SEQ ID NO.: 38   NOV12b
3. SEQ ID NO.: 193   O73884
4. SEQ ID NO.: 194   Q9D9M5
5. SEQ ID NO.: 195   Q9VWF0
6. SEQ ID NO.: 196   Q9SU92
7. SEQ ID NO.: 197   Q9FZ62

```
                   10        20        30        40        50        60
            ....|....|....|....|....|....|....|....|....|....|....|....|
NOV12a    -MSGCFPVSGLRCLSRDGRMAAQGAPRFLLTFDFDETIVDENSDDSIVRAAPGQRLPESL 59
NOV12b    -MSGCFPVSGLRCLSRDGRMAAQGAPRFLLTFDFDETIVDENSDDSIVRAAPGQRLPESL 59
O73884    -MKRCCEGVGLPCLFKGVGMASSRPPKYLLVFDFDGTIINESSDDSIVRAAPGQALPEHI 59
```

```
Q9D9M5   ---------------------MKVLLVFDFDNTIIDDNSDTWIVQCAPDKKLPIEL  35
Q9VWF0   MSSNQEQSPAAVAAAVASCRLRKQQRRLAAFDFDHTIVSQNTDTVVRDLLPTEVTSAKV  60
Q9SU92   ---------------------MAK---IVILFDFDRTLIDGDSDNWVVTEMG---LTEIF  33
Q9FZ62   ---------------------MAKNNNIVIVFDFDKTIIDVDSDNWVVDELG---FTDLF  36

70        80        90       100       110       120
             ....|....|....|....|....|....|....|....|....|....|....|....|
NOV12a   RATYREGFYNEYMQRVFKYLGEQGVRPRDLSAIYEAIPLSPGMSDLLQFVAKQGACFEVI 119
NOV12b   RATYREGFYNEYMQRVFKYLGEQGVRPRDLSAIYEAIPLSPGMSDLLQFVAKQGACFEVI 119
O73884   RQSFREGFYNEYMQRVLAYMGDQGVKMGDFKAVYENIPLSPGMPDLFQFLSKNHELFEII 119
Q9D9M5   QDSYQKGLWTEFMGRVFKYLRDEGVKADELKRAVTSLPFTSGMIELLSFLRMNKDRFDCI  95
Q9VWF0   NELVENDCWTEYMAEVFRLLHEQQVSEARIRDTIRGIPEVPGFVRLIKHLAKR-LHYDLI 119
Q9SU92   HQLRFTLPWNRLMDRMMMELQSQGRSIDDIKSCLKKMPIDSHLIEAIKSAKSS--GCDLK  91
Q9FZ62   NQLLPTMPWNSLMNRMMKELHDHGKTIEEIKQVLRRIPIHPRVIPAIKSAHAL--GCELR  94

130       140       150       160       170       180
             ....|....|....|....|....|....|....|....|....|....|....|....|
NOV12a   LISDANTFGVESSLRAAGHHSLFRRILSNPSGPDARGLLALRPFHTHS-----CARCPAN 174
NOV12b   LISDANTFGVESSLRAAGHHSLFRRILSNPSGPDARGLLALRPFHTHS-----CARCPAN 174
O73884   LISDANMFGIECKLRAAGFYSLFRKIFSNPSSFDKRGYFTLGPYHSHK-----CLDCPAN 174
Q9D9M5   LISDSNSIFIDWVLEAAAFHDVFDHVFINPASFDSSGRLTVKNYHAHS-----CTRCPKN 150
Q9VWF0   LISDSNSVFIDEWLRAHNLADCFVAIFINPAEFDASGRLMVRAHHQQSD----CKLSASN 175
Q9SU92   IVSDANQFFIEKILEHHDLVDCFSEIYTNPTSLDDNGNLRILPYHSDALPPHSCNLCPSN 151
Q9FZ62   IVSDANTLFIETILEHLGIGEFFSEINTNPGLVDEQGRLIVSPYHDFIKSSHGCSRCPPN 154

190       200       210       220       230       240
             ....|....|....|....|....|....|....|....|....|....|....|....|
NOV12a   MCKHKVLSDYLRER-AHDGVHFERLFYVGDGANDFCPMGLLAGGDVAFPRRGYPMHRLIQ 233
NOV12b   MCKHKVLSDYLRER-AHDGVHFERLFYVGDGANDFCPMGLLAGGDVAFPRRGYPMHRLIQ 233
O73884   TCKRKILTEYLAER-AQEEVEFERVFYVGDGANDFCPSVTLTSADVAFPRKGYPMHQMTQ 233
Q9D9M5   ICKNTVLGEFIDKQ-LQKGVRYTRIVYLGDGGNDVCPVTFLKKNDVAMPREGYTLHRTLA 209
Q9VWF0   LCKGRVLEHFVIEQDLRRSIRYDHVFYVGDGNNDICPVLRQRACDFACARKGRAMEKHLL 235
Q9SU92   LCKGLVMDHLRASS--SNDQIPRRFIYLGDGGGDFCPTLKLRECDFVMPRTNYPLWKKIS 209
Q9FZ62   MCKGLIIDRIQASL--TKEGKTSKMILGDGAGDYCPSLGLKAEDYMMPRKNPPVWDLIS 212

250       260       270       280       290       300
             ....|....|....|....|....|....|....|....|....|....|....|....|
NOV12a   EAQKAEPSSFRASVVPWETAADVRLHLQQVLKS-C------------------------ 267
NOV12b   EAQKAEPSSFRASVVPWETAADVRLHLQQVLKS-C------------------------ 267
O73884   EMEKKQPGTFQAIVVPWESATEVARYLQELLKKC------------------------- 268
Q9D9M5   KMSQN-LEPMESSIVVWSSGVETISHLQFLIKM-------------------------- 241
Q9VWF0   RNRSK--LKLRAQLLIWKSGFDLMDQMLALPQLKTPQVQGDGDQPDQDADTDGKVPEVAR 293
Q9SU92   DN----PLLIKAEVKEWSSAEEQQRILLQLVSTITKEEDS-------------------- 245
Q9FZ62   QN----PMLVKATVRDWTDGEDMERILMELINEIMSSEEGEENDKMLSSENCKISVGIVH 268

310
             ....|....|...
NOV12a   ------------- 267
NOV12b   ------------- 267
O73884   ------------- 268
Q9D9M5   ------------- 241
Q9VWF0   RASAVAGPTKSPN 306
Q9SU92   ------------- 245
Q9FZ62   EPIQVPLNLVK-- 279
```

The presence of identifiable domains in the disclosed NOV12 protein was determined by using Pfam and then determining the Interpro number. The results are listed in Table 12H with the statistics and domain description.

TABLE 12H

Domain Analysis of NOV12

| PSSMs Producing Significant Alignments | Score (bits) | E Value |
|---|---|---|
| Hydrolase: domain 1 of 1, from 26 to 225 | -10.8 | 1.9 |

```
Hyd.       ikavvFDkDGTLtdgkeppiaeaivealrelglapleevekllgrgl
           ++ | |+|  |+++ +    + +++++  ++    + +++  ++++
NOV12      RFLLTFDFDETIVDEN---SDDSIVRAAPGQR--LPESLRATYREGF Hyd.       .gerilleggltaell.ld.evlglial.dklypgarealkaLkerGikv
           + ++++     +  +++++++ + ++++ +++ +++ ++++   ++|   +
NOV12      yN-EYMQRVFKYLGEQgVRpRDLSAIYEaIPLSPGMSDLLQFVAKQGACF Hyd.       ailTngdr.naeallealgla.lfdaivdsdevggvgpvvvgKPkpeifl
           ++      +++  +      ++ +  + ++  ++             |++  ++
NOV12      EVIL---IsDANTFGVESSLRaAGHHSLFRRILS--------NPSGPDAR Hyd.       lalerlgvkpeevg.......................p.kvlmvGDgi
           ++     +  + +++ + +   +++  ++   +++ +++ +++    ++||+
NOV12      GLLALRPFHTHSCArcpanmckhkvlsdylrerahdgvhFeRLFYVGDGA Hyd.       nD.apalaaAGvgvamgngg     (SEQ ID NO:198)
           +|  +++  ||  +++ +++
NOV12      NDfCPMGLLAGGDVAFPRRG     (SEQ ID NO:36)
```

Consistent with other known members of the protein phosphatase family of proteins, NOV12 contains a hydrolase domain as illustrated in Table 12H.

NOV12 nucleic acids, and the encoded polypeptides, according to the invention are useful in a variety of applications and contexts. For example, NOV12 nucleic acids and polypeptides can be used to identify proteins that are members of the protein phosphatase family of proteins. The NOV12 nucleic acids and polypeptides can also be used to screen for molecules, which inhibit or enhance NOV12 activity or function. Specifically, the nucleic acids and polypeptides according to the invention may be used as targets for the identification of small molecules that modulate or inhibit, e.g., biological processes that control cell growth and homeostasis. These molecules can be used to treat, e.g., hyper/hypothyroidism, endometriosis, fertility, transplantation, hypogonadism, Alzheimer's disease, Parkinson's disease, neurodegeneration, or grwoth disorders.

In addition, various NOV12 nucleic acids and polypeptides according to the invention are useful, inter alia, as novel members of the protein families according to the presence of domains and sequence relatedness to previously described proteins. For example, the NOV12 nucleic acids and their encoded polypeptides include structural motifs that are characteristic of proteins belonging to the protein phosphatase family. The major protein phosphatases in all cells are highly conserved and widely distributed. They are integrally associated with the regulation of many neuronal functions and have been implicated in the etiology of several neurological disorders. Their involvement in the specific control of individual neuronal functions requires the specific regulation of distinct pools of protein phosphatase inside the cell. This is believed to be mediated by specific proteins which both target the enzyme to specific subcellular locations and modulate its activity towards colocalised substrates.

The NOV12 nucleic acids and polypeptides, antibodies and related compounds according to the invention will be useful in therapeutic and diagnostic applications in the mediation of cell signaling/signal transduction. As such the NOV12 nucleic acids and polypeptides, antibodies and related compounds according to the invention may be used to treat, e.g., hyperthyroidism, hypothyroidism, endometriosis, fertility, Von Hippel-Lindau (VHL) syndrome, cirrhosis, transplantation, hypogonadism, Alzheimer's disease, stroke, tuberous sclerosis, hypercalceimia, Parkinson's disease, Huntington's disease, cerebral palsy, epilepsy, Lesch-Nyhan syndrome, multiple sclerosis, ataxia-telangiectasia, leukodystrophies, behavioral disorders, addiction, anxiety, pain, neurodegeneration, endocrine dysfunctions, diabetes, obesity, growth and reproductive disorders, systemic lupus erythematosus, autoimmune disease, asthma, emphysema, scleroderma, allergy, ARDS, renal artery stenosis, interstitial nephritis, glomerulonephritis, polycystic kidney disease, renal tubular acidosis, IgA nephropathy, hemophilia, hypercoagulation, idiopathic thrombocytopenic purpura, immunodeficiencies, and graft versus host disease.

The NOV12 nucleic acids and polypeptides are useful for detecting specific cell types. For example, expression analysis has demonstrated that a NOV12 nucleic acid is expressed in bone marrow, brain, kidney, liver, lung, lung pleura, pituitary gland, placenta, and thyroid.

Additional utilities for NOV12 nucleic acids and polypeptides according to the invention are disclosed herein.

NOV13

The disclosed NOV13 nucleic acid (alternatively referred to herein as CG56441-01) encodes a novel chloride channel protein CLC-KA-like protein and includes the 1991 nucleotide sequence (SEQ ID NO:39) shown in Table 13A.

An open reading frame for the mature protein was identified beginning with an ATG initiation codon at nucleotides 8–10, and ending with a TAG stop codon at nucleotides 1973–1975. Putative untranslated regions, if any, are found upstream from the initiation codon and downstream from the termination codon. The start and stop codons are in bold letters.

TABLE 13A

NOV13 Nucleotide Sequence (SEQ ID NO:39)

GGGCCTGATGGAGGAGTTTGTGGGGCTGCGTGAGGGCTTCTCAGGGGACCCTGTGACTCTGCAGGAGCTGTGGGG
CCCCTGTCCCCACATCCGCCGAGCCATCCAAGGTGGCCTGGAGTGGCTAAAGCAGAAGGTGTTCCGCCTGGGAGA
AGACTGGTACTTCCTGATGACCCTCGGGGTGCTCATGGCCCTGGTCAGCTATGCCATGAACTTTGCCATCGGGTG
TGTGGTCCGAGGCTTCTCCCAGAGCATCACGCCCTCCTCTGGAGGTTCTGGAATCCCGGAGCTGAAGACCATGTT
GGCGGGTGTGATCTTGGAGGACTACCTGGATATCAAGAACTTTGGGGCCAAGGTGGTGGGCCTCTCCTGCACCCT
GGCCACCGGCAGCACCCTGTTCCTGGGCAAAGTGGGCCCTTTCGTGCACTTGTCTGTAATGATCGCTGCCTACCT
GGGCCGTGTGCGCACCACGACCATCGGGGAGCCTGAGAACAAGAGCAAGCAAAACGAAATGCTGGTGGCAGCGGC
GGCAGTGGGCGTGGCCACAGTCTTTGCAGCTCCCTTCAGCGGCGTCCTGTTCAGCATCGAGGTCATGTCTTCCCA
CTTCTCTGTCCGGGATTACTGGAGGGGCTTCTTTGCGGCCACCTGCGGGGCCTTCATATTCCGGCTCCTGGCAGT
CTTCAACAGCGAGCAGGAGACCATCACCTCCCTCTACAAGACCAGTTTCCGGGTGGACGTTCCCTTCGACCTGCC
TGAGATCTTCTTTTTTGTGGCGCTGGGTGGCATCTGCGGCGTCCTGAGCTGTGCTTACCTCTTCTGTCAGCGAAC
CTTCCTCAGCTTCATCAAGACCAATCGGTACAGCTCCAAACTGCTGGCTACTAGCAAGCCTGTGTACTCCGCTCT
GGCCACCTTGCTTCTCGCCTCCATCACCTACCCGCCTGGTGTGGGCCACTTCCTAGCTTCTCGGCTGTCCATGAA
GCAGCATCTGGACTCGCTGTTCGACAACCACTCCTGGGCGCTGATGACCCAGAACTCCAGCCCACCCTGGCCCGA
GGAGCTCGACCCCCAGCACCTTTGGTGGGAATGGTACCACCCGCGGTTCACCATCTTTGGGACCCTTGCCTTCTT
CCTGGTTATGAAGTTCTGGATGCTGATTCTGGCCACCACCATCCCCATGCCTGCCGGGTACTTCATGCCCATCTT
TATCCTTGGAGCTGCCATCGGGCGCCTCTTGGGAGAGGCTCTTGCCGTCGCCTTCCCTGAGGGCATTGTGACTGG
AGGGGTTACCAATCCCATCATGCCCGGGGGGTATGCTCTGGCAGGGGCTGCAGCCTTCTCAGGGGCTGTGACCCA
CACCATCTCCACGGCGCTGCTGGCCTTTGAGCTGACCGGCCAGATAGTGCATGCACTGCCCGTGCTGATGGCGGT
GCTGGCAGCCAACGCCATTGCACAGAGCTGCCAGCCCTCCTTCTATGATGGCACCATCATTGTCAAGAAGCTGCC
ATACCTGCCACGGATTCTGGGCCGCAACATCGGCTCCCACCATGTGAGGGTGGAGCACTTCATGAACCACAGCAT
CACCACACTGGCCAAGGACACGCCGCTGGAGGAGGTGGTCAAGGTTGTGACCTCCACAGACGTGACCGAGTATCC
CCTGGTGGAGAGCACAGAGTCCCAGATCCTGGTAGGCATCGTGCAGAGGGCCCAGCTGGTGCAGGCCCTCCAGGC
TGAGCCTCCTTCCAGGGCTCCAGGACACCAGCAGCGTCTCCAGGACATCTTGGCCAGGGGCTGCCCCACGGAACC
AGTGACCCTGACGCTATTCTCAGAGACCACCTTGCACCAGGCACAAAACCTCTTTAAGCTGTTGAACCTTCAGTC
CCTCTTCGTGACATCGCGGGGCAGAGCTGTGGGCTGCGTGTCCTGGGTGGAGATGAAGAAAGCAATTTCCAACCT
GACAAATCCGCCAGCTCCAAAGTGAGCCGGCCCAGCAAGAT

The NOV13 protein (SEQ ID NO:40) encoded by SEQ ID NO:39 is 655 amino acid residues in length and is presented using the one-letter amino acid code in Table 13B. The SignalP, Psort and/or Hydropathy results indicate that NOV13 has a signal peptide and is likely to be localized at the plasma membrane with a certainty of 0.6000. Alternatively, a NOV13 polypeptide is located to the Golgi body with a certainty of 0.4000, the endoplasmic reticulum (membrane) with a certainty of 0.1882, or the microbody (peroxisome) with a certainty of 0.3000. The SignalP indicates a likely cleavage site for a NOV13 peptide between positions 66 and 67, i.e., at the dash in the sequence SYA-MN.

TABLE 13B

Encoded NOV13 Protein Sequence (SEQ ID NO:40)

MEEFVGLREGFSGDPVTLQELWGPCPHIRRAIQGGLEWLKQKVFRLGEDWYFLMTLGVLMALVSYAMNFAIGCVV
RGFSQSITPSSGGSGIPELKTMLAGVILEDYLDIKNFGAKVVGLSCTLATGSTLFLGKVGPFVHLSVMIAAYLGR
VRTTTIGEPENKSKQNEMLVAAAAVGVATVFAAPFSGVLFSIEVMSSHFSVRDYWRGFFAATCGAFIFRLLAVFN
SEQETITSLYKTSFRVDVPFDLPEIFFFVALGGICGVLSCAYLFCQRTFLSFIKTNRYSSKLLATSKPVYSALAT
LLLASITYPPGVGHFLASRLSMKQHLDSLFDNHSWALMTQNSSPPWPEELDPQHLWWEWYHPRFTIFGTLAFFLV
MKFWMLILATTIPMPAGYFMPIFILGAAIGRLLGEALAVAFPEGIVTGGVTNPIMPGGYALAGAAAFSGAVTHTI
STALLAFELTGQIVHALPVLMAVLAANAIAQSCQPSFYDGTIIVKKLPYLPRILGRNIGSHHVRVEHFMNHSITT
LAKDTPLEEVVKVVTSTDVTEYPLVESTESQILVGIVQRAQLVQALQAEPPSRAPGHQQRLQDILARGCPTEPVT
LTLFSETTLHQAQNLFKLLNLQSLFVTSRGRAVGCVSWVEMKKAISNLTNPPAPK

SNP variants of NOV13 are disclosed in Example 2.

A search against the Patp database, a proprietary database that contains sequences published in patents and patent publication, yielded several homologous proteins shown in Table 13C.

TABLE 13C

PatP Results for NOV13

| Sequences Producing High-Scoring Segment Pairs: | High Score | Smallest Sum Prob P(N) |
|---|---|---|
| patp:AAY13937 Human CLCNKB protein | 2754 | 0.0 |
| patp:AAR60336 ClC-K1 protein - Rattus rattus - Sprague-Dawley | 2331 | 2.3e−273 |
| patp:AAY69633 Human gastric chloride channel ClC-2G | 1216 | 1.6e−132 |
| patp:AAY69631 Rabbit gastric chloride channel ClC-2G | 1211 | 5.5e−132 |
| patp:AAY69632 Rat brain chloride channel ClC-2 | 1207 | 1.5e−131 |

In a BLAST search of public sequence databases, it was found, for example, that the NOV13 nucleic acid sequence of this invention has 1768 of 1779 bases (99%) identical to a gb:GENBANK-ID:HSCLCHPRA|acc:Z30643.1 mRNA from *H. sapiens* mRNA for chloride channel (putative) 2139 bp. Further, the full amino acid sequence of the disclosed NOV13 protein of the invention has 578 of 579 amino acid residues (99%) identical to, and 578 of 579 amino acid residues (99%) similar to, the 687 amino acid residue ptnr:SWISSPROT-ACC:P51800 protein from Human (CHLORIDE CHANNEL PROTEIN CLC-KA (CLC-K1)).

The NOV13 protein of the invention also has homolgy to the proteins shown in the BLASTP data in Table 13D.

TABLE 13D

NOV13 BLASTP Results

| Gene Index/ Identifier | Protein/Organism | Length of aa | Identity (%) | Positives (%) | Expect Value |
|---|---|---|---|---|---|
| P51800 | Chloride channel protein CLC-KA (ClC-K1) - *Homo sapiens* | 687 | 578/579 (99%) | 578/579 (99%) | 0.0 |
| P51801 | Chloride channel protein CLC-KB (ClC-K2) - *Homo sapiens* | 687 | 531/579 (91%) | 550/579 (94%) | 0.0 |
| P51803 | Chloride channel protein CLCK1 - *Oryctolagus cuniculus* (Rabbit) | 687 | 497/579 (85%) | 535/579 (92%) | 3.1e−300 |
| P51804 | Chloride channel protein CLC-K2 - *Oryctolagus cuniculus* (Rabbit) | 678 | 486/564 (86%) | 522/564 (92%) | 2.3e−293 |
| A57713 | chloride channel ClC-K1 - rat | 687 | 484/579 (83%) | 527/579 (91%) | 2.1e−290 |

A multiple sequence alignment is given in Table 13E, with the NOV13 protein of the invention being shown in line 1 in a ClustalW analysis comparing NOV13 with related protein sequences of Table 13D.

Table 13E. ClustalW Analysis of NOV13

1. SEQ ID NO.: 40    NOV13
2. SEQ ID NO.: 199    P51800
3. SEQ ID NO.: 200    P51801
4. SEQ ID NO.: 201    P51803
5. SEQ ID NO.: 202    P51804
6. SEQ ID NO.: 203    A57713

```
        10        20        30        40        50        60
....|....|....|....|....|....|....|....|....|....|....|....|
NOV13   MEEFVGLREGFSGDPVTLQELWGPCPHIRRAIQGGLEWLKQKVFRLGEDWYFLMTLGVLM  60
P51800  MEELVGLREGFSGDPVTLQELWGPCPHIRRAIQGGLEWLKQKVFRLGEDWYFLMTLGVLM  60
P51801  MEEFVGLREGSSGNPVTLQELWGPCPLIRRGIRGGLEWLKQKLFRLGEDWYFLMTLGVLM  60
P51803  MEELVGLREGSSGNPVALRELWGPCPRLRRGIRGGLEWLKQKLFRVGEDWYFLMTLGVLM  60
P51804  MEELVGLREGSSGNPVALRELSPCPRLRRGIRGGLEWLKQKLFRVGEDWYFLMTLGVLM  60
A57713  MEELVGLREGSSGKPVTLQELWGPCPRIRRGVRRGLEWLKERLFRVGEDWVFLVALGVLM  60

70        80        90       100       110       120
....|....|....|....|....|....|....|....|....|....|....|....|
NOV13   ALVSYAMNFALGCVVR-----------------------------GFSQSITPSSGG   88
P51800  ALVSYAMNFALGCVVRAHQWLYREIGDSHLLRYLSWTVYPVALVSFSSGFSQSITPSSGG  120
P51801  ALVSCAMDLAVESVVRAHQWLYREIGDSHLLRYLSWTVYPVALVSFSSGFSQSITPSSGG  120
P51803  ALISYAMNFALGRVVRAHKWLYREIGDSHLLRYLSWTVYPVALVSFSSGFSQSITPFSGG  120
P51804  ALISYAMNFALGRVVRAHKWLYREIGDSHLLRYLSWTVYPVALVSFSSGFSQSITPFSGG  120
A57713  ALISYAMNFALGRVVRAHKWLYREVGDGHLLRYLSWTVYPVALLSFSSGFSQSISPFSGG  120

130       140       150       160       170       180
....|....|....|....|....|....|....|....|....|....|....|....|
NOV13   SGIPELKTMLAGVILEDYLDIKNFGAKVVGLSCTLATGSTLFLGKVGPFVHLSVMIAAYL  148
P51800  SGIPELKTMLAGVILEDYLDIKNFGAKVVGLSCTLATGSTLFLGKVGPFVHLSVMIAAYL  180
P51801  SGIPEVKTMLAGVVLEDYLDIKNFGAKVVGLSCTLACGSTLFLGKVGPFVHLSVMMAAYL  180
P51803  SGIPELKTILSGVVLENYLDIKNFGAKVVGLSCTLATGSTLFLGKVGPFVHLSVMIAAYL  180
P51804  SGIPELKTILSGVVLENYLDIKNFGAKVVGLSCTLATGSTLFLGKVGPFVHLSVMIAAYL  180
A57713  SGLPELKTMLSGVVLEDYLDIKNFGAKVVGLSCTLATGSTLFLGKVGPFVHLSVMISAYL  180

190       200       210       220       230       240
....|....|....|....|....|....|....|....|....|....|....|....|
NOV13   GRVRTTTIGEPENKSKQNEMLVAAAAVGVATVFAAPFSGVLFSIEVMSSHFSVRDYWRGF  208
P51800  GRVRTTTIGEPENKSKQNEMLVAAAAVGVATVFAAPFSGVLFSIEVMSSHFSVRDYWRGF  240
P51801  GRVRTTTIGEPENKSKQNEMLVAAAAVGVATVFGAPFSGVLFSIEVMSSHFSVWDYWRGF  240
P51803  GRVRTKTIGEAENKSKQNEMLVAGAAVGVATVFAAPFSGVLFCIEVMSSHFSVWDYWRGF  240
P51804  GRVRTKTIGEAENKSKQNEMLVAGAAVGVATVFAAPFSGVLFCIEVMSSHFSVWDYWRGF  240
A57713  GRVRAKTIGETENKAKEIEMLSAAAAVGVATVFAAPFSGVLFSIEVMSSHFSVWNYWRGF  240

250       260       270       280       290       300
....|....|....|....|....|....|....|....|....|....|....|....|
NOV13   FAATCGAFLFRLLAVFNSEQETITSLYKTSFRVDVPFDLPEIFFFVALGGICGVLSCAYL  268
P51800  FAATCGAFLFRLLAVFNSEQETITSLYKTSFRVDVPFDLPEIFFFVALGGICGVLSCAYL  300
P51801  FAATCGAFMFRLLAVFNSEQETITSLYKTSFRVDVPFDLPEIFFFVVLGGLCGILGSAYL  300
P51803  FAATCGAFMFRLLAVFNSEQETITSLYKTSFPVDVPFDLPEIFFFVLLGAICGVASCAYL  300
P51804  FAATCGAFMFRLLAVFNSEQETITSLYKTSFPVDVPFDLPEIFFFVLLGAICGVASCAYL  300
A57713  FAATCGAFMFRLLGVFNSEQETITSVYKTRFRVDVPFDLPEIFFFVALGFICGVLSCAYL  300

310       320       330       340       350       360
....|....|....|....|....|....|....|....|....|....|....|....|
NOV13   FCQRTFLSFIKTNRYSSKLLATSKPVYSALATLLLASITYPPGVGHFLASRLSMKCHLDS  328
P51800  FCQRTFLSFIKTNRYSSKLLATSKPVYSALATLLLASITYPPGVGHFLASRLSMKCHLDS  360
P51801  FCQRIFFGFIRNNRFSSKLLATSKPVYSALATLVLASITYPPSAGRFLASRLSMKCHLDS  360
P51803  VCQRTFLAFTKTNKLISKLMATSKPLYAALAATVLASITYPPGVGRFMASRLSMREHLDI  360
P51804  VCQRTFLAFTKTNKLISKLMATSKPLYAALAATVLASITYPPGVGRFMASRLSMREHLDI  360
A57713  FCQRTFLRFIKTNRYTSRLLATSKPSYAALVALVLASITYPPGVGRFMASRLSMAEHLHS  360

370       380       390       400       410       420
....|....|....|....|....|....|....|....|....|....|....|....|
NOV13   LFDNHSWALMTQNSSPPWPEELDPQHLWWEWYHPRFTIFGTLAFFLVMKFWMLILATTIP  388
```

```
P51800    LFDNHSWALMTQNSSPPWPEELDPQHLWWEWYHPRFTIFGTLAFFLVMKFWMLILATTIP  420
P51801    LFDNHSWALMTQNSSPPWPEELDPQHLWWEWYHPRFTIFGTLAFFLVMKFWMLILATTIP  420
P51803    LFDNHSWALLTRNSSPPWPAEPDPQHLWWEWYHPRFTIFGTLAFFLVMKFWMLILATTIP  420
P51804    LFDNHSWALLTRNSSPPWPAEPDPQHLWWEWYHPRFTIFGTLAFFLVMKFWMLILATTIP  420
A57713    LFDNNSWALMTNSSPPWPAEPDPQNLWLEWCHPRFTIFGTLAFFLVMKFWMLILATTIP   420

430       440       450       460       470       480
          ....|....|....|....|....|....|....|....|....|....|....|....|
NOV13     MPAGYFMPIFILGAAIGRLLGEALAVAFPEGIVTGGVTNPIMPGGYALAGAAAFSGAVTH  448
P51800    MPAGYFMPIFILGAAIGRLLGEALAVAFPEGIVTGGVTNPIMPGGYALAGAAAFSGAVTH  480
P51801    MPAGYFMPIFVYGAAIGRLFGETLSFIFPEGIVAGGLTNPIMPGGYALAGAAAFSGAVTH  480
P51803    MPAGYFLPIFILGAAIGRLLGEALSVAFPEGIVAGGVINPIMPGGYALAGAAAFSGAVTH  480
P51804    MPAGYFLPIFILGAAIGRLLGEALSVAFPEGIVAGGVINPIMPGGYALAGAAAFSGAVTH  480
A57713    MPAGYFMPIFILGAAIGRLLGEALSVAFPEGIVAGREVNPIMPGGYALAGAAAFSGAVTH  480

490       500       510       520       530       540
          ....|....|....|....|....|....|....|....|....|....|....|....|
NOV13     TISTALLAFELTGQIVHALPVLMAVLAANAIAQSCQPSFYDGTIIVKKLPYLPRILGRNI  508
P51800    TISTALLAFELTGQIVHALPVLMAVLAANAIAQSCQPSFYDGTIIVKKLPYLPRILGRNI  540
P51801    TISTALLAFEVTGQIVHALPVLMAVLAANAIAQSCQPSFYDGTVIVKKLPYLPRILGRNI  540
P51803    SISTALLAFELTGQIVHALPVLMAVLAANAIAQSCQPSFYDGTIMVKKLPYLPWIRGRPI  540
P51804    SISTALLAFELTGQIVHALPVLMAVLAANAIAQSCQPSFYDGTIMVKKLPYLPWIRGRPI  540
A57713    TISTALLAFELTGQIVHALPVLMAVLAANAISQNCQPSFYDGTIMAKKLPYLPRIRGRQI  540

550       560       570       580       590       600
          ....|....|....|....|....|....|....|....|....|....|....|....|
NOV13     GSHHVRVEHFMNHSITTLAKDTPLEEVVKVVTSTDVTEYPLVESTESQLLVGIVQRAQLV  568
P51800    GSHHVRVEHFMNHSITTLAKDTPLEEVVKVVTSTDVTEYPLVESTESQLLVGIVQRAQLV  600
P51801    GSHRVRVEHFMNHSITTLAKDTPLEEVVKVVTSTDVAEYPLVESTESQLLVGIVRRAQLV  600
P51803    NSHRVIVEHFMRRAISTLAPDAALEVVVKVLTSTDEAEYPLVESTESQLLVGIVQRAQLV  600
P51804    NSHRVIVEHFMRRAISTLAPDAALEVVVKVLTSTDEAEYPLVESTESQLLVGIVQRAQLV  600
A57713    GSYPVTVEHFMNCALTTLAKDTPLEEVVKVVTSTEVSQYPLVETRESQTLVGIVERTHLV  600

610       620       630       640       650       660
          ....|....|....|....|....|....|....|....|....|....|....|....|
NOV13     QALQAEPPSRAPGHQQRLQDILARGCPTEPVTLTIFSETTLHQAQNLFKLLNLQSLFVTS  628
P51800    QALQAEPPSRAPGHQQCLQDILARGCPTEPVTLTLFSETTLHQAQNLFKLLNLQSLFVTS  660
P51801    QALKAEPPSWAPGHQQCLQDILAAGCPTEPVTLKLSPETSLHEAHNLFELLNLHSLFVTS  660
P51803    QALQAEAPARASGQQRCLQDILAGGCPTEPVTLTLSPETSLHQAHNLFELLNLRSLYVTS  660
P51804    QALQAEAPARASGQQRCLQDILAGGCPTEPVTLTLSPETSLHQAHNLFELLNLRSLYVTS  660
A57713    QALQTQPTPWAPGQERFLQDILAGGCPTQPVTLQLSPETSLYQAHSLFERLTLQSLFVTS  660

670       680
          ....|....|....|....|..
NOV13     RGRAVGCVSWVEMKKAISNLTNPPAPK  655
P51800    RGRAVGCVSWVEMKKAISNLTNPPAPK  687
P51801    RGRAVGCVSWVEMKKAISNLTNPPAPK  687
P51803    KGRAVGYVSWVELKKAISALTNPPPAK  687
P51804    KGRAVVYVSWVERQHTGF---------  678
A57713    RGKAVGSVSWAELKKAISTLINPPAPK  687
```

The presence of identifiable domains in the disclosed NOV13 protein was determined by using Pfam and then determining the Interpro number. The results are listed in Table 13F with the statistics and domain description.

enhance NOV13 activity or function. Specifically, the nucleic acids and polypeptides according to the invention may be used as targets for the identification of small molecules that modulate or inhibit, e.g., physiological func-

TABLE 13F

Domain Analysis of NOV13

| PSSMs Producing Significant Alignments | Score (bits) | E Value |
| --- | --- | --- |
| voltage_CLC: domain 1 of 1, from 67 to 484 | 558.6 | 1.7e-164 |

```
CLC      fslglvllaallvkkfAPaAaGSGIPEiKtiLsGikivgkeylrlrt
         + + + +  ++ + +  |  +|||||| |++| |+++ +++++++
NOV13    MNFAIGCVVRGFSQSITPSSGGSGIPELKTMLAGVIL--EDYLDIKN CLC      lvvKvvGlalslgsG..lslGKEGPfVHiGaciAalLsklgstslrlqfs
         + +|++|+ +++++|+++++| |+||+||++ ++|+ |++++++     +
NOV13    FGAKVVGLSCTLATGstLFLGKVGPFVHLSVMIAAYLGRVRTT-----TI CLC      lfkyseedrRkdrrdllaaGaAaGvAaaFgAPiGGVLFslEevssenayf
         + +++++ +       +++++++|+|+|+ |+||+ |||  |++|++++   ++
NOV13    GEPENKSKQ----NEMLVAAAAVGVATVFAAPFSGVLFSIEVMSS---HF CLC      rvknlwrgLFFasavaafvlrlinsffvsgkcgqFgtglalFdvsfrtdr
         ++ ++++ ||+++++++++++++  ++++ ++  +++ +++++++++++
NOV13    SVRDYWRG-FFAATCGAFIFRLLA---VFNSEQE--TITSLYKTSFRVD- CLC      dpftlfELplFillGifgGllGalFnrlnrkvlkfrkknkykskifglpp
         +++++ |+++|+++|  ++|++++++ ++ ++++++ +++++ ++++ +++
NOV13    VPFDLPEIFFFVALGGICGVLSCAYLFCQRTFLSFIKTNRYSSKLLATSK CLC      vlepalvglltgvlsfplplllgcagglelvegrtlnelfdnCtwg.eyn
         +++++ +++++++++++++++++++++++ +  +++ +++++++  +++
NOV13    PVYSALATLLLASITYPPGVGHFLASRLSMKQ--HLDSLFDNHSWAlMTQ CLC      dlasllcdtpedavlslfdhwngpgegdfsaftlLlllliakfiltiltf
         +++++++++ +++++++  ++++   ++++++++|++++++++++ ++++
NOV13    NSSPPWPEELDPQHLWW--EWYH---PRFTIFGTLAFFLVMKFWMLILAT CLC      GigvPgGlFvPslviGAavGrlvGiaverlimavlsHdwfpiglfcegfp
         ++++|+|  |+|++++||++|+++|     +  +++  +++++++ + +
NOV13    TIPMPAGYFMPIFILGAAIGRLLG-----EALAVA----FPEGIVTGGVT CLC      dcilePGlYAvvGAAAflgGvvrmTvslaVIvfElTGnlsvilPlMvAvl
         ++++ ||+||++|||+ + ++++|++++++ +|+||++ + +|+++|++
NOV13    NPIM-PGGYALAGAAAFSG-AVTHTISTALLAFELTGQIVHALPVLMAVL CLC      iakavadslg    (SEQ ID NO:204)
         +++++++++
NOV13    AANAIAQSCQ    (SEQ ID NO:40)
```

Consistent with other known members of the voltage-gated chloride channel family of proteins, NOV13 contains CLC domains as illustrated in Table 13F.

The NOV13 nucleic acid, and the encoded polypeptide, according to the invention are useful in a variety of applications and contexts. For example, NOV13 nucleic acids and polypeptides can be used to identify proteins that are members of the voltage-gated chloride channel family of proteins. The NOV13 nucleic acids and polypeptides can also be used to screen for molecules, which inhibit or tion such as cell volume regulation, membrane potential stabilization, signal transduction, or transepithelial transport. These molecules can be used to treat, e.g., diseases associated with the kidney such as renal artery stenosis, diabetes, or renal tubular acidosis.

In addition, the NOV13 nucleic acid and polypeptide according to the invention are useful, inter alia, as novel members of the protein families according to the presence of domains and sequence relatedness to previously described proteins. For example, the NOV13 nucleic acid and polypeptide include structural motifs that are characteristic of proteins belonging to the family of voltage-gated chloride channel proteins. All functionally characterized members of the CLC family transport chloride, some in a voltage-regulated process. These channels serve a variety of physiological functions such as cell volume regulation, membrane potential stabilization, signal transduction, and transepithelial transport.

The NOV13 nucleic acid and polypeptide, antibodies and related compounds according to the invention will be useful in therapeutic and diagnostic applications in the mediation of kidney diseases. As such the NOV13 nucleic acid and polypeptide, antibodies and related compounds according to the invention may be used to treat, e.g., diabetes, autoimmune disease, renal artery stenosis, interstitial nephritis, glomerulonephritis, polycystic kidney disease, systemic lupus erythematosus, renal tubular acidosis, IgA nephropathy, hypercalceimia, or Lesch-Nyhan syndrome.

The NOV13 nucleic acid and polypeptide are useful for detecting specific cell types. For example, expression analysis has demonstrated that a NOV13 nucleic acid is expressed in the kidney.

Additional utilities for the NOV13 nucleic acid and polypeptide according to the invention are disclosed herein.

NOV14

The disclosed NOV14 nucleic acid (alternatively referred to herein as CG56443-01) encodes a novel mast cell function-associated antigen (MAFA)-like protein and includes the 645 nucleotide sequence (SEQ ID NO:41) shown in Table 14A. The NOV14 nucleic acid disclosed herein maps to chromosome 19.

An open reading frame for the mature protein was identified beginning with an ATG initiation codon at nucleotides 31–33, and ending with a TAA stop codon at nucleotides 604–606. Putative untranslated regions, if any, are found upstream from the initiation codon and downstream from the termination codon. The start and stop codons are in bold letters.

TABLE 14A

NOV14 Nucleotide Sequence (SEQ ID NO:41)

<u>ACTGGAGTGTTGCTACAAAGATACCCCAAAA</u>ATGTGGAAGCAACTGTGGAACTGGGTAACAGGCCTTCCAGAAAGC
CCCCAATTTGAGTCCCATCAPAGGTTAGTTCTTCTGCCTATTCTTGAAATTCATGTAAACTCAAAATCTTACAGA
ATGTATTCATTCTGTTTGGGTTTCTTAACTCTTGTGAGACAGAGTCTTGCTCTGTCACCCAGGCTGGAATGCAGT
GGCGCCATCTCGGCTCACTGCAAGATCTGTGAGCCGTGCCCTACGTCGTGGCTGCCCTTCGGGGGCTCCTGCTAC
TATTTCTCTGTGCCGAAGACCACGTGGGCAGAGGCGCAGGGCCACTGCGCCGATGCCAGCGCACATCTGGCTGCC
TTCCCAGAAGATAGGAAAGTCGCCTTTTATTCTGTACTTTTGGGTAGGTGCCTCTTCGGAATAGGCCTGGCCAGA
GTGGGTGGGTGGAGGTGGCAGGTGGCACCGGGGACCCAGATAGATGCACCCGCAGTAGGACAAGGGGCCTGCTTC
TGTCAGGAAAGCATTTCTGGTCTTCCTGCCTCGGAACTCAGGCTGGAAAAGTGGTGGCACTGCTCAAAAACACTG
CAATAA<u>CAAACCACAGATGTCTGTTCCAAAGATTACAATCAAAAC</u>

The NOV14 protein (SEQ ID NO:42) encoded by SEQ ID NO:41 is 191 amino acid residues in length and is presented using the one-letter amino acid code in Table 14B. The SignalP, Psort and/or Hydropathy results indicate that NOV14 has a signal peptide and is likely to be localized at the plasma membrane with a certainty of 0.7900. Alternatively, a NOV14 polypeptide is located to the microbody (peroxisome) with a certainty of 0.5804, the Golgi body with a certainty of 0.3000, or the endoplasmic reticulum (membrane) with a certainty of 0.2000. The SignalP indicates a likely cleavage site for a NOV14 peptide between positions 57 and 58, i.e., at the dash in the sequence SLA-LS.

TABLE 14B

Encoded NOV14 Protein Sequence (SEQ ID NO:42)

MWKQLWNWVTGLPESPQFESHQRLVLLPILEIHVNSKSYRMYSFCLGFLTLVRQSLALSPRLECSGAISAHCKIC
EPCPTSWLPFGGSCYYFSVPKTTWAEAQGHCADASAHLAAFPEDRKVAFYSVLLGRCLFGIGLARVGGWRWQVAP
GTQIDAPAVGQGACFCQESISGLPASELRLEKWWHCSKTLQ

A search against the Patp database, a proprietary database that contains sequences published in patents and patent publication, yielded several homologous proteins shown in Table 14C.

TABLE X14C

PatP Results for NOV14

| Sequences Producing High-Scoring Segment Pairs: | High Score | Smallest Sum Prob P (N) |
|---|---|---|
| patp:AAE11760 Mouse mast cell function associated antigen (MAFA) protein | 266 | 8.1e−23 |
| patp:AAR77033 Mammalian mast cell function-associated antigen (MAFA) | 252 | 2.5e−21 |
| patp:AAW88277 Rat mast cell function-associated antigen (MAFA) | 252 | 2.5e−21 |
| patp:AAE11761 Rat mast cell function associated antigen (MAFA) protein | 252 | 2.5e−21 |
| patp:AAM25760 Human protein sequence | 239 | 5.9e−20 |

In a BLAST search of public sequence databases, it was found, for example, that the NOV14 nucleic acid sequence of this invention has 109 of 151 bases (72%) identical to a gb:GENBANK-ID:HSA007973|acc:AJ007973.1 mRNA from Homo sapiens LGMD2B gene. Further, the full amino acid sequence of the disclosed NOV14 protein of the invention has 62 of 179 amino acid residues (34%) identical to, and 87 of 179 amino acid residues (48%) similar to, the 188 amino acid residue ptnr:SPTREMBL-ACC:O88713 protein from Mouse (MAST CELL FUNCTION-ASSOCIATED ANTIGEN 2F1 (MAFA)).

The NOV14 protein of the invention also has homolgy to the proteins shown in the BLASTP data in Table 14D.

TABLE 14D

NOV14 BLASTP Results

| Gene Index/ Identifier | Protein/Organism | Length of aa | Identity (%) | Positives (%) | Expect Value |
|---|---|---|---|---|---|
| O88713 | MAST CELL FUNCTION-ASSOCIATED ANTIGEN 2F1 (MAFA) (KILLER CELL LECTIN-LIKE RECEPTOR G1) - Mus musculus (Mouse) | 188 | 62/179 (34%) | 87/179 (48%) | 1.0e−22 |
| Q64335 | MAFA PROTEIN - Rattus norvegicus (Rat) | 188 | 59/179 (32%) | 84/179 (46%) | 3.1e−21 |
| O75613 | ITIM-CONTAINING RECEPTOR MAFA-L - Homo sapiens (Human) | 189 | 45/149 (30%) | 71/149 (47%) | 3.8e−16 |
| Q96E93 | SIMILAR TO KILLER CELL LECTIN-LIKE RECEPTOR SUBFAMILY G, MEMBER 1 - Homo sapiens (Human) | 195 | 45/149 (30%) | 71/149 (47%) | 3.8e−16 |
| O43198 | MAST CELL FUNCTION-ASSOCIATED ANTIGEN- Homo sapiens (Human) | 189 | 44/149 (29%) | 70/149 (46%) | 1.2e−14 |

A multiple sequence alignment is given in Table 14E, with the NOV14 protein of the invention being shown in line 1 in a ClustalW analysis comparing NOV14 with related protein sequences of Table 14D.

Table 14E. ClustalW Analysis of NOV14

1. SEQ ID NO.: 42   NOV14
2. SEQ ID NO.: 205  O88713
3. SEQ ID NO.: 206  Q64335
4. SEQ ID NO.: 207  O75613
5. SEQ ID NO.: 208  Q96E93
6. SEQ ID NO.: 209  O43198

```
                10        20        30        40        50        60
       ....|....|....|....|....|....|....|....|....|....|....|....|
NOV14   MWKQLWNWVTGLPESPQFESHQRLVLLPILEIHVNSKSYRMYSFCLGFLTLVRQSLALSP  60
O88713  MADSSIYSTLELPEAPQVQDSRWKLKAVLHRPHLS---RFAMVALGLLTVILMSLLMYQ  57
Q64335  MADNSIYSTLELPAAPRVQDDSRWKVKAVLHRPCVS---YLVMVALGLLTVILMSLLYQ  57
O75613  MTDSVIYSMLELPTATQAQNDYGPQQKSSSSRPSCS---CLVAIALGLLTAVLLSVLLYQ 57
Q96E93  MTDSVIYSMLELPTATQAQNDYGPQQKSSSSRPSCS---CLVAIALGLLTAVLLSVLLYQ 57
O43198  MTDSVIYSMLELPTATQAQNDYGPQQKSSSSKPSCS---CLVAITLGLLTAVLLSVLLYQ 57

70        80        90       100       110       120
       ....|....|....|....|....|....|....|....|....|....|....|....|
NOV14   RLECSGAISAHCKICEPCPTSWLPFGGSCYYFSVPKTTWAEAQGHCADASAHLAAFPEDR 120
O88713  RILCCGSKDSTCSHCPSCPILWTRNGSHCYYFSMEKKDWNSSLKFCADKGSHLLTFPDNQ 117
Q64335  RTLCCGSKGFMCSQCSRCPNLWMRNGSHCYYFSMEKRDWNSSLKFCADKGSHLLTFPDNQ 117
O75613  WILCQGSNYSTCASCPSCPDRWMKYGNHCYYFSVEEKDWNSSLEFCLARDSHLLVITDNQ 117
Q96E93  WILCQGSNYSTCASCPSCPDRWMKYGNHCYYFSVEEKDWNSSLEFCLARDSHLLVITDNQ 117
O43198  WILCQGSNYSTCASCPSCPDRWMKYGNHCYYFSVEEKDWNSSLEFCLARDSHLLVITDNQ 117

130       140       150       160       170       180
       ....|....|....|....|....|....|....|....|....|....|....|....|
NOV14   KVAFYSVLLGRCLFGIGLARVGGWRWQVAPGTQIDAPAVGQGACFCQES-ISGLPASELR 179
O88713  GVKLFGEYLGQDFYWIGLRNIDGWRWEGGPALSLR-ILTNSLIQRCGAIHRNGLQASSCE 176
Q64335  GVNLFQEYVGEDFYWIGLRDIDGWRWEDGPALSLS-ILSNSVVQKCGTTHRCGLHASSCE 176
O75613  EMSLLQVFLSEAFCWIGLRNNSGWRWEDGSPLNFSRISSNSFVQTCGAINKNGLQASSCE 177
Q96E93  EMSLLQVFLSEAFCWIGLRNNSGWRWEDGSPLNFSRISSNSFVQTCGAINKNGLQASSCE 177
O43198  EMSLLQVFLSEAFCWIGLRNNSGWRWEDGSPLNFSRISSNSFVQTCGAINKNGLQASSCE 177

190
       ....|....|....|...
```

```
NOV14    IEKWWHCSKTLQ------      191
O88713   VALQWICKKVLY------      188
Q64335   VALQWICEKVLP------      188
O75613   VPLHWVCKKVRL------      189
Q96E93   VPLHWVCKKCPFADQALF      195
O43198   VPLHGVCKKVRL------      189
```

The presence of identifiable domains in the disclosed NOV14 protein was determined by using Pfam and then determining the Interpro number. The results are listed in Table 14F with the statistics and domain description.

TABLE 14F

Domain Analysis of NOV14

| PSSMs Producing Significant Alignments | Score (bits) | E Value |
|---|---|---|
| Xlink: domain 1 of 1, from 87 to 114 | 0.9 | 8.2 |

| | | |
|---|---|---|
| Xlink | GeVFhyrapsgRYkltFeEAqaaClrqgAriA | (SEQ ID NO:210) |
| | \| ++  +    + +\|\|+  \|++  \| +\| | |
| NOV14 | GSCYYFSVPK----TTWAEAQGHCADASAHLA | (SEQ ID NO:42) |

Consistent with other known members of the MAFA family of proteins, NOV14 contains an extracellular link (Xlink) domains as illustrated in Table 14F.

The NOV14 nucleic acid, and the encoded polypeptide, according to the invention are useful in a variety of applications and contexts. For example, NOV14 nucleic acids and polypeptides can be used to identify proteins that are members of the MAFA family of proteins. The NOV14 nucleic acids and polypeptides can also be used to screen for molecules, which inhibit or enhance NOV14 activity or function. Specifically, the nucleic acids and polypeptides according to the invention may be used as targets for the identification of small molecules that modulate or inhibit, e.g., cellular activation/cascade, allergic response, or the release of mediators such as histamine. These molecules can be used to treat, e.g., atopic disorders such as asthma, allergies, cancers such as lymphoma, or immunological disorders.

In addition, the NOV14 nucleic acid and polypeptide according to the invention are useful, inter alia, as novel members of the protein families according to the presence of domains and sequence relatedness to previously described proteins. For example, the NOV14 nucleic acid and polypeptide include structural motifs that are characteristic of proteins belonging to the family of MAFA proteins. Mast cells are part of the immune system. They carry Fcepsilon type receptors on their surface to which IgE antibodies bind specifically. Crosslinking by multivalent antigens initiates a biochemical cascade which causes the secretion of neurotransmitters and thus allergic reaction of the immediate type. It was recently discovered that this membrane protein carries an Immune Receptor Tyrosine based Inhibition Motif (ITIM).

The NOV14 nucleic acid and polypeptide, antibodies and related compounds according to the invention will be useful in therapeutic and diagnostic applications in the mediation of immune response, cancer, or atopy. As such the NOV14 nucleic acid and polypeptide, antibodies and related compounds according to the invention may be used to treat, e.g., cancer, autoimmune disease, allergies, immunodeficiencies, transplantation, graft versus host disease (GVHD), or lymphaedema.

The NOV14 nucleic acid and polypeptide are useful for detecting specific cell types. For example, expression analysis has demonstrated that a NOV14 nucleic acid is expressed in lymph, testis, liver, breast, melanocyte, heart, uterus, brain, and spleen.

Additional utilities for the NOV14 nucleic acid and polypeptide according to the invention are disclosed herein.

NOV15

The NOV15 proteins descibed herein are novel murine epidermal growth factor-6 (MEGF6). The NOV15 nucleic acids disclosed herein map to chromosome 1. Six alternative novel NOV15 nucleic acids and polypeptides are disclosed herein, namely NOV15a, NOV15b, NOV15c, NOV15d, NOV15e and NOV15f.

NOV15a

A NOV15 variant is NOV15a (alternatively referred to herein as CG56449-01), which encodes the 7337 nucleotide sequence (SEQ ID NO:43) shown in Table 15A. An open reading frame for the mature protein was identified beginning with an ATG codon at nucleotides 1–3 and ending with a TGA codon at nucleotides 4213–4215. Putative untranslated regions, if any, downstream from the termination codon and upstream from the initiation codon are underlined. The start and stop codons are in bold letters.

TABLE 15A

NOV15a Nucleotide Sequence (SEQ ID NO:43)

ATGCCCATGGGACATTCTGACAGGTGGTCTTGGCGTCTCCTGAGGCTGGCACTGCCACTCCCAGTCTGGTTGCCG
GCTGGGGGTGGCCGAGGCGCTGACTCTCCATGTCTCTGTTCCAGGCCCCACGTGTGTGCTGAGCAGGAGCTGACC
CTGGTGGGCCGCCGCCAGCCGTGCGTGCAGGCCTTAAGCCACACGGTGCCGGTGTGGAAGGCCGGCTGTGGGTGG
CAGGCGTGGTGCGTGGGTCATGAGCGGAGGACCGTCTACTACATGGGCTACAGGCAGGTGTATACCACGGAGGCC
CGGACCGTGCTCAGGTGCTGCCGAGGGTGGATGCAGCAGCCCGACGAGGAGGGCTGCCTCTCGGATGTGGGTGAG
TGTGCCAACGCCAACGGGGGCTGTGCGGGTCGGTGCCGGGACACCGTGGGGGGCTTCTACTGCCGCTGGCCCCCC
CCCAGCCACCAGCTGCAGGGTGATGGCGAGACTTGCCAAGATGTGGACGAATGCCGAACCCACAACGGTGGCTGC
CAGCACCGGTGCGTGAACACCCCAGGCTCCTACCTCTGTGAGTGCAAGCCCGGCTTCCGGCTCCACACTGACAGC
AGGACCTGCGCCATTAACTCCTGCGCCCTGGGCAATGGCGGCTGCCAGCACCACTGTGTCCAGCTCACAATCACT
CGGCATCGCTGCCAGTGCCGGCCCGGGTTCCAGCTCCAGGAGGACGGCAGGCATTGTGTCCGTAGAAGCCCGTGT

TABLE 15A-continued

NOV15a Nucleotide Sequence (SEQ ID NO:43)

GCCAACAGGAACGGCAGCTGCATGCACAGGTGCCAGGTGGTCCGGGGCCTCGCCCGCTGTGAGTGCCACGTGGGC
TATCAGCTAGCAGCGGACGGCAAGGCCTGTGAAGATGTGGACGAATGTGCCGCAGGGCTGGCCCAGTGTGCCCAT
GGCTGCCTCAACACCCAGGGGTCCTTCAAGTGCGTGTGTCACGCGGGCTATGAGCTGGGCGCCGATGGCCGGCAG
TGCTACCGTATTGAGATGGAAATCGTGAACAGCTGTGAGGCCAACAACGGCGGCTGCTCCCATGGCTGCAGCCAC
ACCAGTGCTGGGCCCCTGTGCACCTGTCCCCGCGGCTACGAGCTGGACACAGATCAGAGGACCTGCATCAGATGT
CGACGACTGTGCAGACAGCCCGTGCTGCAGCAGGTGTGCACCAACAACCCTGGCGGGTACGAGTGCGGCTGCTAC
GCCGGCTACCGGCTCAGTGCCGATGGCTGCGGCTGCGAGGATGTGGATGAGTGCGCCTCCAGCCGTGGCGGCTGC
GAGCACCACTGCACCAACCTGGCCGGCTCCTTCCAGTGCTCCTGCGAGGCCGGCTACCGGCTGCACGAGGACCGT
AGGGGCTGCAGCGCCCTGGAGGAGCCGATGGTGGACCTGGACGGCGAGCTGCCTTTCGTGCGGCCCCTGCCCCAC
ATTGCCGTGCTCCAGGACGAGCTGCCGCAACTCTTCCAGGATGACGACGTCGGGGCCGATGAGGAAGAGGCAGAG
TTGCGGGGCGAACACACGCTCACAGAGAAGTTTGTCTGCCTGGATGACTCCTTTGGCCATGACTGCAGCTTGACC
TGTGATGACTGCAGGAACGGAGGGACCTGCCTCCTGGGCCTGGATGGCTGTGATTGCCCCGAGGGCTGGACTGGG
CTCATCTGCAATGAGAGTTGTCCTCCGGACACCTTTGGGAAGAACTGCAGCTTCTCCTGCAGCTGTCAGAATGGT
GGGACCTGCGACTCTGTCACGGGGGCCTGCCGCTGCCCCCCGGGTGTCAGTGGAACTAACTGTGAGGATGGCTGC
CCCAAGGGCTACTATGGCAAGCACTGTCGCAAGAAATGCAACTGTGCCAACCGGGGCCGGTGCCACCGCCTCTAC
GGGGCCTGCCTCTGCGACCCAGGGCTCTACGGCCGCTTCTGCCACCTCGCCTGCCCGCCGTGGGCCTTTGGGCCG
GGCTGCTCGGAGGAGTGCCAGTGTGTGCAGCCCCACACGCAGTCCTGTGACAAGAGGGATGGCAGCTGCTCCTGC
AAGGCTGGCTTCCGGCGCGAGCGCTGTCAGGCAGAGTGTGAGCCGGGCTACTTTGGGCCGGGGTGCTGGCAGGCA
TGCACCTGCCCAGTGGGCGTGGCCTGTGACTCCGTGAGCGGCGAGTGTGGGAAGCGGTGTCCTGCTGGCTTCCAG
GGAGAGGACTGTGGCCAAGAGTGCCCGGTGGGGACCTTTGGCGTGAACTGCTCGAGCTCCTGCTCCTGTGGGGGG
GCCCCCTGCCACGGGGTCACGGGGCAGTGCCGGTGTCCGCCGGGGAGGACTGGGGAAGACTGTGAGGCAGGTGAG
TGTGAGGGCCTCTGGGGGCTGGGCTGCCAGGAGATCTGCCCAGCATGCCATAACGCTGCTCGCTGCGACCCTGAG
ACCGGAGCCTGCCTGTGCCTCCCTGGCTTTGTCGGCAGCCGCTGCCAGGACTGTGAGGCAGGCTGGTATGGTCCC
AGCTGCCAGACAATGTGCTCTTGTGCCAATGATGGGCACTGCCACCAAGACACGGGACACTGCAGCTGTGCCCCC
GGGTGGACCGGCTTTAGCTGCCAGAGAGCCTGTGATACTGGGCACTGGGGACCTGACTGCAGCCACCCCTGCAAC
TGCAGCGCTGGCCACGGGAGCTGTGATGCCATCAGCGGCCTGTGTCTGTGAGGCTGGCTACGTGGGCCCGCGG
TGCGAGCAGTCAGAGTGTCCCCAGGGCCACTTTGGGCCCGGCTGTGAGCAGCGGTGCCAGTGTCAGCATGGAGCA
GCCTGTGACACGTCAGCGGGGCCTGCACCTGCCCGGCCGGCTGGAGGGGCACCTTCTGCGAGCATGCCTGCCCG
GCCGGCTTCTTTGGATTGGACTGTCGCAGTGCCTGCAACTGCACCGCCGGAGCTGCCTGTGATGCCGTGAATGGC
TCCTGCCTCTGCCCCGCTGGCCGCCGGGGCCCCGCTGTGCCGAGAGTGCCTGCCCAGCCCACACCTACGGGCAC
AATTGCAGCCAGGCCTGTGCCTGCTTTAACGGGGCCTCCTGTGACCCTGTCCACGGGCAGTGCCACTGTGCCCCT
GGCTGGATGGGGCCCTCCTGCCTGCAGGCCTGCCCTGCCGGCCTGTACGGCGACAACTGTCGGCATTCCTGCCTC
TGCCAGAACGGAGGGACCTGTGACCCTGTCTCAGGCCACTGTGCGTGCCCAGAGGGCTGGGCCGGCCTGGCCTGT
GAGGTAGAGTGCCTCCCCCGGGACGTCAGAGCTGGCTGCCGGCACAGCGGCGGTTGCCTCAACGGGGGCCTGTGT
GACCCGCACACGGGCCGCTGCCTCTGCCCAGCCGGCTGGACTGGGGACAAGTGTCAGAGCCCTGCAGCCTGTGCC
AAGGGCACATTCGGGCCTCACTGTGAGGGGCGCTGTGCCTGCCGGTGGGGAGGCCCCTGCCACCTTGCCACCGGG
GCCTGCCTCTGCCCTCCGGGGTGGCGGGGGCCTCATCTTTCTGCAGCCTGCCTGCGGGGCTGGTTTGGAGAGGCC
TGTGCCCAGCGCTGCAGCTGCCCGCCTGGCGCTGCCTGCCACCACGTCACTGGGGCCTGCCGCTGTCCCCCTGGC
TTCACTGGCTCCGGCTGCGAGCAGGCCTGCCACCCGGCCAGCTTTGGGGAGGACTGTGCGCAGATGTGCCAGTGT
CCCGGTGAGAACCCGGCCTGCCACCCTGCCACCGGGACCTGCTCATGTGCTGCTGGCTACCACGGCCCCAGCTGC
CAGCAACGATGTCCGCCCGGGCGGTATGGGCCAGGCTGTGAACAGCTGTGTGGGTGTCTCAACGGGGGCTCCTGT
GATGCGGCCACGGGGGCCTGCCGCTGCCCCACTGGGTTCCTCGGGACGGACTGCAACCTCACCTGTCCGCAGGGC
CGCTTCGGCCCCAACTGCACCCACGTGTGTGGGTGTGGCCAGGGGGCGGCCTGCGACCCTGTGACCGGCACCTGC
CTCTGCCCCCGGGGAGAGCCGGCGTCCGCTGTGAGCGAGGCTGCCCCCAGAACCGGTTTGGCGTGGGCTGCGAG
CACACCTGCTCCTGCAGAAATGGGGGCCTGTGCCACGCCAGCAAGCGGCAGCTGCTCCTGTGGCCTGGGCTGGAC
GGGGCGGCACTGCGAGCTGGCCTGTCCCCTGGGCGCTACGGAGCCGCCTGCCATCTGGAGTGCTCCTGCCACAA
CAACAGCACGTGTGAGCCTGCCACGGGCACCTGCCGCTGCGGCCCCGGCTTCTATGGCCAGGCCTGCGAGCACCC
<u>CTGTCCCCCTGGCTTCCACGGGGCTGGCTGCCAGGGGTTGTGCTGGTGTCAACATGGAGCCCCCTGCGACCCCAT</u>
<u>CAGTGGCCGATGCCTCTGCCCTGCCGGCTTCCACGGCCACTTCTGTGAGAGGGGGTGTGAGCCAGGTTCATTTGG</u>
<u>AGAGGGCTGCCACCAGCGCTGTGACTGTGACGGGGGGCACCCTGTGACCCTGTCACCGGTCTCTGCCTTTGCCC</u>
<u>ACCAGGGCGCTCAGGAGCCACCTGTAACCTGGATTGCAGAAGGGGCCAGTTTGGGCCCAGCTGCACCCTGCACTG</u>
<u>TGACTGCGGGGTGGGGCTGACTGCGACCCTGTCAGTGGGCAGTGTCACTGTGTGGATGGCTACATGGGGCCCAC</u>
<u>GTGCCGGGAAGGTGGGCCCCTCCGGCTCCCGAGAACCCGTCCTTAGCCCAGGGCTCAGCGGGCACACTGCCCGC</u>
<u>CTCCAGCAGACCCACATCCCGGAGCGGTGGACCAGCGAGGCACTAGTAGAGGCAGTCCCGTGGAGCCCGCCTCTC</u>
<u>CAGTCCCAGCCAGAGGGGACCCTGGCCTTTGGTGACCACTGAGAAGGACACTTCACGGGCCCAGAGCTCCTGGTA</u>
<u>CTGCCCTTCCTTTGAGGGCCGTGGAGGGCTGTGGACAGCCCAGCAACCTGTCGCTCTTGGAGGCTGGTGTGGCCT</u>
<u>TGAGGAGGGAAGCCTCGCATGGCCGCTGGAAGAGAGGCGCCTCCTGGCCTGGCTCTGCAGAACCCAGGGGCACGC</u>
<u>TCTGGGCCTGGGCTGAGGAAGTCCCGCTCTCCCCGCGGCTCTGAGTTGGACTGAGGACAGGTGTGGGCGCCAGTG</u>
<u>TGGGTGCAGGCGCAGGTGCAGGCACAGGGCCACTGTCCTCCAGGCAGGCTTTTGGTGCTAGGCCCTGGGACTGG</u>
<u>AAGTCGCCCAGCCCGTATTTATGTAAAGGTATTTATGGGCCACTGCACATGCCCGCTGCAGCCCTGGGATCAGCT</u>
<u>GGAAGCTGCCTGTCATCTCCTGCCCAATCCCCAGAAACCCTGATTCAGGTCTGCAGGCTCCTGCGGGCTCACCAG</u>
<u>GCTGCTGGCTCCGGTACCATGTAAACCTAGGAAGGTAAAGGAGCAGGCAACCTCCTCGTGGCCTGTGTGTTTGCT</u>
<u>GTGTTACGTGGACTCTGTGTGGGCTCCTCCCTGGGGCCCGGCCAGCATAACGGTGCACCCAGGGACCTCCCAGTG</u>
<u>CACCCGGGGCCCTTTGCAGGGGTGGGGGTGCCACACAAGTGAAGAAGTTGGGACTCATCTCAGTTCCCAGTGCTA</u>

TABLE 15A-continued

NOV15a Nucleotide Sequence (SEQ ID NO:43)

TTGAGGAGAACGCTGGGGCTGCATTCATTACCGCTGAGACCCAGAGACTGGCTGTTCCCAGAGAATGGCCCAGGG
GGAGGAGGGCTGGTGTGGAGGGGCAACCTGGACTGAGGCCGAACTCCCTTGGGCTCACCCCACCCACCCCTACCT
GAGCATCAGCAGTGGGGGGAGGGCAGCATCGCAGGGGCAGGGACTCCCTGGGTGAGGACAGACCAGCCCTCCCGA
GCACCTGGCACTCATGGGCTGAGGCTGACTTCTCCTGGAAGAAGGGCCCAGAGTGGAAGGAAGAGGCAGAGGGTA
GAGGTGGTGGCTGGGGGCTCCTCTGCAGAGTGGGGTGGCCAATGGAGAGGGCTGCACTCACACCGCAACATAGGA
CTCTCTCTCCCTTAAGAAGGCCCCCTTAGGGTCTGGGCTGCCGCCCCCATCACCCTAAAACCAGCCAAGGTAGCT
GAGGCCCCAGGGCAGACAATTTCACCAGCAGGANGAGGAGGAGTCCAGTGAGCTTGGTTGCTCACAGACAGCAAG
GGAGCTGTCACAGAGGAAGCTGATGAATGGACCGCTGTGGGGAGACTTTAAAGTAGAACAGTGATAAGGGAGGGC
AGGATGGTGGGGATGCAGAAGCAGCAGCCAGAGAGAGACGGACTGGGGTGCAGACGGAGTGTGGAAAACGCATAC
CTTGAAATGAAGCATCCAGCAGATGGGGTGAGTGGATACAGCTCAGGAGATTCTCCCAGGAATAGCAGGGAGGCG
TAAAGAGAGACAACGTACAGAGATAGATGAATGGAAATGGGTAAGGGAGGTGTTCATTCACATCCATCTAACTGC
AAAATACAAAAGTAAGAAGTCATTGACATGAAGCAACGACGACCAAGACGTTCTCAGATCTAAAGGTGAATGATC
TCAGTCAGCCTGGAAATGCACAAGGTGGAAAAATAACATAAAAAAGCCATAAGACCTTGAAGAACATCAATGTCA
AAGATAAATTCTAAAGTCCCAGAGAAAAAAGAATGGGAATCAAATTGACCTCAGACTATACGTGAGAAACACGGA
GAGCCAGAAAACTGTGATGTTCCATCCTCAGAGTTTGAAGGAAATATTTGAAGGCTGAATTTTACATCCAGCTAA
ACTATCAAAGGCATGCAAAGTCCATGTTATTCTTAGGCCTTCAAGGCCTCGGCCATTTTTCTACAGAAAAGCCTG
ATTTTAAAATGCTCTTAGAGACGTTCTCCAGCCAGAAGAGAAAAGAAGCCAGGAGGGTGCTCTGAGATATTCAGTC
ACCACAGTTCCCAAATGGCCTAGGAATTCAGAGAGTCAGAATATCACCATTACTCCCCAATGGGAACCCCCGACA
GTCTCAGCATGGTGTGAGGGTGTGGACGGGGGGCCTGGCAGGTACCAATCACTCATCCCGCTCAGTGAAGACACA
GTGTTCAGCTACGGAAGCCATAAGGCAGGCCGAGCTTCTGCCCATCCGGAGGAAATCTCAGCTATCCAACGGCGG
TCAGGAGCAGAGGAAAATAAAGCAGAATAACTAGAAAACACGCTCACAGATCCTAATGTTAACGGTTACAAATGA
CGACGGAAAAACAAACTCCTGACCATATATTATATAGTTTCAAGCAGCAAGAAGGAGGATATTGAACATTCTCAA
CACACATAATAAACGCTTGAGATGATGATATGCTCATTACCCTGATTTGATCACTAGACATNCCATGTATCAAAA
CATCACTGTGTATCCGATGAATATCTACAATTATTGTCAATTAAAAACATCATTAAAAACAA

The NOV15a protein (SEQ ID NO:44) encoded by SEQ ID NO:43 is 1404 amino acid residues in length and is presented using the one-letter amino acid code in Table 15B. Although the SignalP, Psort and/or Hydropathy results indicate that NOV15a has a signal peptide and is likely to be localized in the mitochondrial matrix space with a certainty of 0.4753, the NOV15a protein disclosed here is similar to the EGF family, some members of which are released extracellularly. Alternatively, a NOV15a polypeptide is located to the microbody (peroxisome) with a certainty of 0.3000, the mitochondrial inner membrane with a certainty of 0.1802, or the mitochondrial intermembrane space with a certainty of 0.1802. The SignalP indicates a likely cleavage site for a NOV15a peptide is between positions 31 and 32, i.e., at the dash in the sequence GRG-AD.

TABLE 15B

Encoded NOV15a Protein Sequence (SEQ ID NO:44)

MPMGHSDRWSWRLLRLALPLPVWLPAGGGRGADSPCLCSRPHVCAEQELTLVGRRQPCVQALSHTVPVWKAGCGW
QAWCVGHERRTVYYMGYRQVYTTEARTVLRCCRGWMQQPDEEGCLSDVGECANANGGCAGRCRDTVGGFYCRWPP
PSHQLQGDGETCQDVDECRTHNGGCQHRCVNTPGSYLCECKPGFRLHTDSRTCAINSCALGNGGCQHHCVQLTIT
RHRCQCRPGFQLQEDGRHCVRRSPCANRNGSCMHRCQVVRGLARCECHVGYQLAADGKACEDVDECAAGLAQCAH
GCLNTQGSFKCVCHAGYELGADGRQCYRIEMEIVNSCEANNGGCSHGCSHTSAGPLCTCPRGYELDTDQRTCIRC
RRLCRQPVLQQVCTNNPGGYECGCYAGYRLSADGCGCEDVDECASSRGGCEHHCTNLAGSFQCSCEAGYRLHEDR
RGCSALEEPMVDLDGELPFVRPLPHIAVLQDELPQLFQDDDVGADEEEAELRGEHTLTEKFVCLDDSFGHDCSLT
CDDCRNGGTCLLGLDGCDCPEGWTGLICNESCPPDTFGKNCSFSCSCQNGGTCDSVTGACRCPPGVSGTNCEDGC
PKGYYGKHCRKKCNCANRGRCHRLYGACLCDPGLYGRFCHLACPPWAFGPGCSEECQCVQPHTQSCDKRDGSCSC
KAGFRGERCQAECEPGYFGPGCWQACTCPVGVACDSVSGECGKRCPAGFQGEDCGQECPVGTFGVNCSSSCSCGG
APCHGVTGQCRCPPGRTGEDCEAGECEGLWGLGCQEICPACHNAARCDPETGACLCLPGFVGSRCQDCEAGWYGP
SCQTMCSCANDGHCHQDTGHCSCAPGWTGFSCQRACDTGHWGPDCSHPCNCSAGHGSCDAISGLCLCEAGYVGPR
CEQSECPQGHFGPGCEQRCQCQHGAACDHVSGACTCPAGWRGTFCEHACPAGFFGLDCRSACNCTAGAACDAVNG
SCLCPAGRRGPRCAESACPAHTYGHNCSQACACFNGASCDPVHGQCHCAPGWMGPSCLQACPAGLYGDNCRHSCL
CQNGGTCDPVSGHCACPEGWAGLACEVECLPRDVRAGCRHSGGCLNGGLCDPHTGRCLCPAGWTGDKCQSPAACA
KGTFGPHCEGRCACRWGGPCHLATGACLCPPGWRGPHLSAACLRGWFGEACAQRCSCPPGAACHHVTGACRCPPG
FTGSGCEQACPPGSFGEDCAQMCQCPGENPACHPATGTCSCAAGYHGPSCQQRCPPGRYGPGCEQLCGCLNGGSC
DAATGACRCPTGFLGTDCNLTCPQGRFGPNCTHVCGCGQGAACDPVTGTCLCPPGRAGVRCERGCPQNRFGVGCE
HTCSCRNGGLCHASKRQLLLWPGLDGAALRAGLSPWALRSRLPSGVLLPQQQHV

SNP variants of NOV15a are disclosed in Example 2.

NOV15b

Alternatively, a NOV15 variant is NOV15b (alternatively referred to herein as CG56449-02), which includes the 7319 nucleotide sequence (SEQ ID NO:45) shown in Table 15C. An open reading frame for the mature protein was identified beginning with an ATG codon at nucleotides 1–3 and ending with a TGA codon at nucleotides 4195–4197. Putative untranslated regions, if any, downstream from the termination codon and upstream from the initiation codon are underlined. The start and stop codons are in bold letters.

TABLE 15G

NOV15b Nucleotide Sequence (SEQ ID NO:45)

ATGCCCATGGGACATTCTGACAGGTGGTCTTGGCGTCTCCTGAGGCTGGCACTGCCACTCCCAGTCTGGTTGCCG
GCTGGGGGTGGCCGAGGCGCTGACTCTCCATGTCTCTGTTCCAGGCCCCACGTGTGTGCTGAGCAGGAGCTGACC
CTGGTGGGCCGCCGCCAGCCGTGCGTGCAGGCCTTAAGCCACACGGTGCCGGTGTGGAAGGCCGGCTGTGGGTGG
CAGGCGTGGTGCGTGGGTCATGAGCGGAGAACCGTCTACTACATGGGCTACAGGCAGGTGTATACCACGGAGGCC
CGGACCGTGCTCAGGTGCTGCCGAGGGTGGACGCAGCAGCCCGACGAGGAGGGCTGCCTCTCGGCTGAATGCAGC
GCCAGCCTCTGTTTTCACGGTGGCCGTTGTGTGCCAGGCTCAGCCCAGCCGTGTCACTGTCCCCCCGGCTTCCAG
GGACCCCGCTGTCAGTATGATGTGGACGAATGCCGAACCCACAACGGTGGCTGCCAGCACCGGTGCGTGAACACC
CCAGGCTCCTACCTCTGTGAGTGCAAGCCCGGCTTCCGGCTCCACACTGACAGCAGGACCTGCCTGGCCATTAAC
TCCTGCGCCCTGGGCAATGGCGGCTGCCAGCACCACTGTGTCCAGCTCACAATCACTCGGCATCGCTGCCAGTGC
CGGCCCGGGTTCCAGCTCCAGGAGGACGGCAGGCATTGTGTCCGTAGAAGCCCGTGTGCCAACAGGAACGGCAGC
TGCATGCACAGGTGCCAGGTGGTCCGGGGCCTCGCCCGCTGTGAGTGCCACGTGGGCTATCAGCTAGCAGCGGAC
GGCAAGGCCTGTGAAGATGTGGACGAATGTGCCGCAGGGCTGGCCCAGTGTGCCCATGGCTGCCTCAACACCCAG
GGGTCCTTCAAGTGCGTGTGTCACGCGGGCTATGAGCTGGGCGCCGATGGCCGGCAGTGCTACCGTATTGAGATG
GAAATCGTGAACAGCTGTGAGGCCAACAACGGCGGCTGCTCCCATGGCTGCAGCCACACCAGTGCTGGGCCCCTG
TGCACCTGTCCCCGCGGCTACGAGCTGGACACAGATGCAGGACCTGCATCAGATGTCGACGACTGTGCAGACAG
CCCGTGCTGCAGCAGGTGTGCACCAACAACCCTGGCGGTACGAGTGCGGCTGCTACGCCGGCTACCGGCTCAGT
GCCGATGGCTGCGGCTGCGAGGATGTGGATGAGTGCGCCTCCAGCCGTGGCGGCTGCGAGCACCACTGCACCAAC
CTGGCCGGCTCCTTCCAGTGCTCCTGCGAGGCCGGCTACCGGCTGCACGAGGACCGTAGGGGCTGCAGCGCCCTG
GAGGAGCCGATGGTGGACCTGGACCGGCGAGCTGCCTTTCGTGCGGCCCCTGCCCCACATTGCCGTGCTCCAGGAC
GAGCTGCCGCAACTCTTCCAGGATGACGACGTCGGGGCCGATGAGGAAGAGGCAGAGTTGCGGGGCGAACACACG
CTCACAGAGAAGTTTGTCTGCCTGGATGACTCCTTTGGCCATGACTGCAGCTTGACCTGTGATGACTGCAGGAAC
GGAGGGACCTGCCTCCTGGGCCTGGATGGCTGTGATTGCCCCGAGGGCTGGACTGGGCTCATCTGCAATGAGAGT
TGTCCTCCGGACACCTTTGGGAAGAACTGCAGCTTCTCCTGCAGCTGTCAGAATGGTGGGACCTGCGACTCTGTC
ACGGGGGCCTGCCGCTGCCCCCCGGGTGTCAGTGGAACTAACTGTGAGGATGGCTGCCCCAAGGGCTACTATGGC
AAGCACTGTCGCAAGAAATGCAACTGTGCCAACCGGGGCCGGTGCCACCGCCTCTACGGGGCTGCCTCTGCGAC
CCAGGGCTCTACGGCCGCTTCTGCCACCTCGCCTGCCCGCCGTGGGCCTTTGGGCCGGCCTGCTCGGAGGAGTGC
CAGTGTGTGCAGCCCCACACGCAGTCCTGTGACAAGAGGGATGGCAGCTGCTCCTGCAAGGCTGGCTTCCGGGGC
GAGCGCTGTCAGGCAGAGTGTGAGCCGGGCTACTTTGGGCCCGGGGTGCTGGCAGGCATGCACCTGCCCAGTGGGC
GTGGCCTGTGACTCCGTGAGCGGCGAGTGTGGGAAGCGGTGTCCTGCTGGCTTCCAGGGAGAGGACTGTGGCCAA
GAGTGCCCGGTGGGGACCTTTGGCGTGAACTGCTCGAGCTCCTGCTCCTGTGGGGGGGCCCCCTGCCACGGGGTC
ACGGGGCAGTGCCGGTGTCCGCCGGGGAGGACTGGGGAAGACTGTGAGGCAGGTGAGTGTGAGGGCCTCTGGGGG
CTGGGCTGCCAGGAGATCTGCCCAGCATGCCATAACGCTGCTCGCTGCGACCCTGAGACCGGAGCCTGCCTGTGC
CTCCCTGGCTTTGTCGGCAGCCGCTGCCAGGACTGTGAGGCAGGCTGGTATGGTCCCAGCTGCCAGACAATGTGC
TCTTGTGCCAATGATGGGCACTGCCACCAAGACACGGGACACTGCAGCTGTGCCCCGGGTGGACCGGCTTTAGC
TGCCAGAGAGCCTGTGATACTGGGCACTGGGGACCTGACTGCAGCCACCCCTGCAACTGCAGCGCTGGCCACGGG
AGCTGTGATGCCATCAGCGGCCTGTGTCTGTGTGAGGCTGGCTACGTGGGCCCGCGGTGCGAGCAGTCAGAGTGT
CCCCAGGGCCACTTTGGGCCCGGCTGTGAGCAGCGGTGCCAGTGTCAGCATGGAGCAGCCTGTGACCACGTCAGC
GGGGCCTGCACCTGCCCGGCCGGCTGGAGGGGCACCTTCTGCGAGCATGCCTGCCCGGCCGGCTTCTTTGGATTG
GACTGTCGCAGTGCCTGCAACTGCACCGCCGGAGCTGCCTGTGATGCCGTGAATGGCTCCTGCCTCTGCCCCGCT
GGCCGCCGGGGCCCCCGCTGTGCCGAGAGTGCCTGCCCAGCCCACACCTACGGGCACAATTGCAGCCAGGCCTGT
GCCTGCTTTAACGGGGCCTCCTGTGACCCTGTCCACGGGCAGTGCCACTGTGCCCCTGGCTGGATGGGGCCCTCC
TGCCTGCAGGCCTGCCCTGCCGGCCTGTACGGCGACAACTGTCGGCATTCCTGCCTCTGCCAGAACGGAGGGACC
TGTGACCCTGTCTCAGGCCACTGTGCGTGCCCAGAGGGCTGGGCCGGCCTGGCCTGTGAGGTAGAGTGCCTCCCC
CGGGACGTCAGAGCTGGCTGCCGGCACAGCGGCGGTTGCCTCAACGGGGGCCTGTGTGACCCGCACACGGGCCGC
TGCCTCTGCCCAGCCGGCTGGACTGGGGACAAGTGTCAGAGCCCTGCAGCCTGTGCCAAGGGCACATTCGGGCCT
CACTGTGAGGGGCGCTGTGCCTGCCGGTGGGGAGGCCCCTGCCACCTTGCCACCGGGGCCTGCCTCTGCCCTCCG
GGGTGGCGGGGGCCTCATCTTTCTGCAGCCTGCCTGCGGGGCTGGTTTGGAGAGGCCTGTGCCCAGCGCTGCAGC
TGCCCGCCTGGCGCTGCCTGCCACCACGTCACTGGGCCTGCCGCTGTCCCCCTGGCTTCACTGGCTCCGGCTGC
GAGCAGGCCTGCCCACCCGGCAGCTTTGGGGAGGACTGTGCGCAGATGTGCCAGTGTCCCGGTGAGAACCCGGCC
TGCCACCCTGCCACCGGGACCTGCTCATGTGCTGCTGGCTACCACGGCCCCAGCTGCCAGCAACGATGTCCGCCC
GGGCGGTATGGGCCAGGCTGTGAACAGCTGTGTGGGTGTCTCAACGGGGGCTCCTGTGATGCGGCCACGGGGGCC
TGCCGCTGCCCCACTGGGTTCCTCGGGACGGACTGCAACCTCACCTGTCCGCAGGGCCGCTTCGGCCCCAACTGC
ACCCACGTGTGTGGGTGTGGGCAGGGGGCGGCCTGCGACCCTGTGACCGCACCTGCCTCTGCCCCCGGGGAGA
GCCGGCGTCCGCTGTGAGCGAGGCTGCCCCCAGAACCGGTTTGGCGTGGGCTGCGAGCACACCTGCTCCTGCAGA
AATGGGGGCCTGTGCCACGCCAGCAAGCGGCAGCTGCTCCTGTGGCCTGGGCTGGACGGGGCGGCACTGCGAGCT
GGCCTGTCCCCTGGGCGCTACGGAGCCGCCTGCCATCTGGAGTGCTCCTGCCACAACAACAGCACGTGTGAGCC
<u>TGCCACGGGCACCTGCCGCTGCGGCCCCGGCTTCTATGGCCAGGCCTGCGAGCACCCCTGTCCCCCTGGCTTCCA</u>
<u>CGGGGCTGGCTGCCAGGGGTTGTGCTGGTGTCAACATGGAGCCCCCTGCGACCCCATCAGTGGCCGATGCCTCTG</u>
<u>CCCTGCCGGCTTCCACGGCCACTTCTGTGAGAGGGGGTGTGAGCCAGGTTCATTTGGAGAGGGCTGCCACCAGCG</u>
<u>CTGTGACTGTGACGGGGGGGCACCCTGTGACCCTGTCACCGGTCTCTGCCTTTGCCCACCAGGGCGCTCAGGAGC</u>
<u>CACCTGTAACCTGGATTGCAGAAGGGGCCAGTTTGGGCCCAGCTGCACCCTGCACTGTACCTGCGGGGGTGGGGC</u>
<u>TGACTGCGACCCTGTCAGTGGGCAGTGTCACTGTGTGGATGGCTACATGGGGCCCACGTGCCGGGAAGGTGGGCC</u>
<u>CCTCCGGCTCCCCGAGAACCCGTCCTTAGCCCAGGGCTCAGCGGGCACACTGCCCGCCTCCAGCAGACCCACATC</u>
<u>CCGGAGCGGTGGACCAGCGAGGCACTAGTAGAGGCAGTCCCGTGGAGCCCGCCTCTCCAGTCCCAGCCAGAGGGG</u>
<u>ACCCTGGCCTTTGGTGACCACTGAGAAGGACACTTCACGGGCCCAGAGCTCCTGGTACTGCCCTTCCTTTGAGGG</u>
<u>CCGTGGAGGCCTGTGGACAGCCCAGCAACCTGTCGCTCTTGGAGGCTGGTGTGGCCTTGAGGAGGGAAGCCTCGC</u>
<u>ATGGCCGCTGGAAGAGAGGCGCCTCCTGGCCTGGCTCTGCAGAACCCAGGGGCACGCTCTGGGCCTGGGCTGAGG</u>
<u>AAGTCCCGCTCTCCCCGCGGCTCTGAGTTGGACTGAGGACAGGTGTGGGCCCCAGTGTGGGTGCAGGCGCAGGTG</u>
<u>CAGGCACAGGGCCACTGTCCTCCAGGCAGGCTTTTTGGTGCTAGGCCCTGGGACTGGAAGTCGCCCAGCCCGTAT</u>
<u>TTATGTAAAGGTATTTATGGGCCACTGCACATGCCCGCTGCAGCCCTGGGATCAGCTGGAAGCTGCCTGTCATCT</u>

TABLE 15G-continued

NOV15b Nucleotide Sequence (SEQ ID NO:45)

CCTGCCCAATCCCCAGAAACCCTGATTCAGGTCTGCAGGCTCCTGCGGGCTCACCAGGCTGCTGGCTCCGGTACC
ATGTAAACCTAGGAAGGTAAAGGAGCAGGCAACCTCCTCGTGGCCTGTGTGTTTGCTGTGTTACGTGGACTCTGT
GTGGGCTCCTCCCTGGGGCCCGGGCCAGCATAACGGTGCACCCAGGGACCTCCCAGTGCACCCGGGGCCCTTTGCA
GGGGTGGGGGTGCCACACAAGTGAAGAAGTTGGGACTCATCTCAGTTCCCAGTGCTATTGAGGAGAACGCTGGGG
CTGCATTCATTACCGCTGAGACCCAGAGACTGGCTGTTCCCAGAGAATGGCCCAGGGGGAGGAGGGCTGGTGTGG
AGGGGCAACCTGGACTGAGGCCGAACTCCCTTGGGCTCACCCCACCCACCCCTACCTGAGCATCAGCAGTGGGGG
GAGGGCAGCATCGCAGGGGCAGGGACTCCCTGGGTGAGGACAGACCAGCCCTCCCGAGCACCTGGCACTCATGGG
CTGAGGCTGACTTCTCCTGGAAGAAGGGCCCAGAGTGGAAGGAAGAGGCAGAGGGTAGAGGTGGTGGCTGGGGGC
TCCTCTGCAGAGTGGGGTGGCCAATGGAGAGGGCTGCACTCACACCGCAACATAGGACTCTCTCTCCCTTAAGAA
GGCCCCCTTAGGGTCTGGGCTGCCGCCCCCATCACCCTAAAACCAGCCAAGGTAGCTGAGGCCCCAGGGCAGACA
ATTTCACCAGCAGGANGAGGAGGAGTCCAGTGAGCTTGGTTGCTCACAGACAGCAAGGGAGCTGTCACAGAGGAA
GCTGATGAATGGACCGCTGTGGGGAGACTTTAAAGTAGAACAGTGATAAGGGAGGGCAGGATGGTGGGGATGCAG
AAGCAGCAGCCAGAGAGAGACGGACTGGGGTGCAGACGGAGTGTGGAAAACGCATACCTTGAAATGAAGCATCCA
GCAGATGGGGTGAGTGGATACAGCTCAGGAGATTCTCCCAGGAATAGCAGGGAGGCGTAAAGAGAGACAACGTAC
AGAGATAGATGAATGGAAATGGGTAAGGGAGGTGTTCATTCACATCCATCTAACTGCAAAATACAAAACTAAGAA
GTCATTGACATGAAGCAACGACGACCAAGACGTTCTCAGATCTAAAGGTGAATGATCTCAGTCAGCCTGGAAATG
CACAAGGTGGAAAAATAACATAAAAAAGCCATAAGACCTTGAAGAACATCAATGTCAAAGATAAATTCTAAAGTC
CCAGAGAAAAAAGAATGGGAATCAAATTGACCTCAGACTATACGTGAGAAACACGGAGGAGCCAGAAAACTGTGAT
GTTCCATCCTCAGAGTTTGAAGGAAATATTTGAAGGCTGAATTTTACATCCAGCTAAACTATCAAAGGCATGCAA
AGTCCATGTTATTCTTAGGCCTTCAAGGCCTCGGCCATTTTTCTACAGAAAAGCCTGATTTTAAAATGCTCTTAG
AGACGTTCTCCAGCCAGAAGAGAAAGAAGCCAGGAGGGTGCTCTGAGATATTCAGTCACCACAGTTCCCAAATGG
CCTAGGAATTCAGAGAGTCAGAATATCACCATTACTCCCCAATGGGAAACCCCCGACAGTCTCAGCATGGTGTGAG
GGTGTGGACGGGGGGCCTGGCAGGTACCAATCACTCATCCCGCTCAGTGAAGACACAGTGTTCAGCTACGGAAGC
CATAAGGCAGGCCGAGCTTCTGCCCATCCGGAGGAAATCTCAGCTATCCAACGGCGGTCAGGAGCAGAGGAAAAT
AAAGCAGAATAACTAGAAAACACGCTCACAGATCCTAATGTTAACGGTTACAAATGACGACGGAAAAACAAACTC
CTGACCATATATTATATAGTTTCAAGCAGCAAGAAGGAGGATATTGAACATTCTCAACACACATAATAAACGCTT
GAGATGATGATATGCTCATTACCCTGATTTGATCACTAGACATNCCATGTATCAAAACATCACTGTGTATCCGAT
GAATATCTACAATTATTGTCAATTAAAAACATCATTAAAAACAA

The NOV15b protein (SEQ ID NO:46) encoded by SEQ ID NO:45 is 1398 amino acid residues in length and is presented using the one-letter amino acid code in Table 15D. Although the SignalP, Psort and/or Hydropathy results indicate that NOV15b has a signal peptide and is likely to be localized in the mitochondrial matrix space with a certainty of 0.4753, the NOV15b protein disclosed here is similar to the EGF family, some members of which are released extracellularly. Alternatively, a NOV15b polypeptide is located to the microbody (peroxisome) with a certainty of 0.3000, the mitochondrial inner membrane with a certainty of 0.1802, or the mitochondrial intermembrane space with a certainty of 0.1802. The SignalP indicates a likely cleavage site for a NOV15b peptide is between positions 31 and 32, i.e., at the dash in the sequence GRG-AD.

TABLE 15D

Encoded NOV15b Protein Sequence (SEQ ID NO:46)

MPMGHSDRWSWRLLRLALPLPVWLPAGGGRGADSPCLCSRPHVCAEQELTLVGRRQPCVQALSHTVPVWKAGCGW
QAWCVGHERRTVYYMGYRQVYTTEARTVLRCCRGWTQQPDEEGCLSAECSASLCFHGGRCVPGSAQPCHCPPGFQ
GPRCQYDVDECRTHNGGCQHRCVNTPGSYLCECKPGFRLHTDSRTCLAINSCALGNGGCQHHCVQLTITRHRCQC
RPGFQLQEDGRHCVRRSPCANRNGSCMHRCQVVRGLARCECHVGYQLAADGKACEDVDECAAGLAQCAHGCLNTQ
GSFKCVCHAGYELGADGRQCYRIEMEIVNSCEANNGGCSHGCSHTSAGPLCTCPRGYELDTDQRTCIRCRRLCRQ
PVLQQVCTNNPGGYECGCYAGYRLSADGCGCEDVDECASSRGGCEHHCTNLAGSFQCSCEAGYRLHEDRRGCSAL
EEPMVDLDGELPFVRPLPHIAVLQDELPQLFQDDDVGADEEEAELRGEHTLTEKFVCLDDSFGHDCSLTCDDCRN
GGTCLLGLDGCDCPEGWTGLICNESCPPDTFGKNCSFSCSCQNGGTCDSVTGACRCPPGVSGTNCEDGCPKGYYG
KHCRKKCNCANRGRCHRLYGACLCDPGLYGRFCHLACPPWAFGPGCSEECQCVQPHTQSCDKRDGSCSCKAGFRG
ERCQAECEPGYFGPGCWQACTCPVGVACDSVSGECGKRCPAGFQGEDCGQECPVGTFGVNCSSSCSCGGAPCHGV
TGQCRCPPGRTGEDCEAGECEGLWGLGCQEICPACHNAARCDPETGACLCLPGFVGSRCQDCEAGWYGPSCQTMC
SCANDGHCHQDTGHCSCAPGWTGFSCQRACDTGHWGPDCSHPCNCSAGHGSCDAISGLCLCEAGYVGPRCEQSEC
PQGHFGPGCEQRCQCQHGAACDHVSGACTCPAGWRGTFCEHACPAGFFGLDCRSACNCTAGAACDAVNGSCLCPA
GRRGPRCAESACPAHTYGHNCSQACACFNGASCDPVHGQCHCAPGWMGPSCLQACPAGLYGDNCRHSCLCQNGGT
CDPVSGHCACPEGWAGLACEVECLPRDVRAGCRHSGGCLNGGLCDPHTGRCLCPAGWTGDKCQSPAACAKGTFGP
HCEGRCACRWGGPCHLATGACLCPPGWRGPHLSAACLRGWFGEACAQRCSCPPGAACHHVTGACRCPPGFTGSGC
EQACPPGSFGEDCAQMCQCPGENPACHPATGTCSCAAGYHGPSCQQRCPPGRYGPGCEQLCGCLNGGSCDAATGA
CRCPTGFLGTDCNLTCPQGRFGPNCTHVCGCGQGAACDPVTGTCLCPPGRAGVRCERGCPQNRFGVGCEHTCSCR
NGGLCHASKRQLLLWPGLDGAALRAGLSPWALRSRLPSGVLLPQQQHV

NOV15c

Alternatively, a NOV15 variant is NOV15c (alternatively referred to herein as CG56449-03), which includes the 4733 nucleotide sequence (SEQ ID NO:47) shown in Table 15F. An open reading frame for the mature protein was identified beginning with an ATG codon at nucleotides 1–3 and ending with a TAG codon at nucleotides 4351–4353. Putative untranslated regions, if any, downstream from the termination codon and upstream from the initiation codon are underlined. The start and stop codons are in bold letters.

TABLE 15E

NOV15c Nucleotide Sequence (SEQ ID NO:47)

ATGCCCATGGGACATTCTGACAGGTGGTCTTGGCGTCTCCTGAGGCTGGCACTGCCACTCCCAGTCTGGTTGCCG
GCTGGGGGTGGCCGAGGCGCTGACTCTCCATGTCTCTGTTCCAGGCCCCACGTGTGTGCTGAGCAGGAGCTGACC
CTGGTGGGCCGCCGCCAGCCGTGCGTGCAGGCCTTAAGCCACACGGTGCCGGTGTGGAAGGCCGGCTGTGGGTGG
CAGGCGTGGTGCGTGGGTCATGAGCGGAGAACCGTCTACTACATGGGCTACAGGCAGGTGTATACCACGGAGGCC
CGGACCGTGCTCAGGTGCTGCCGAGGGTGGACGCAGCAGCCCGACGAGGAGGGCTGCCTCTCGGCTGAATGCAGC
GCCAGCCTCTGTTTTCACGGTGGCCGTTGTGTGCCAGGCTCAGCCCAGCCGTGTCACTGTCCCCCCGGCTTCCAG
GGACCCCGCTGTCAGTATGATGTGGACGAATGCCGAACCCACAACGGTGGCTGCCAGCACCGGTGCGTGAACACC
CCAGGCTCCTACCTCTGTGAGTGCAAGCCCGGCTTCCGGCTCCACACTGACAGCAGGACCTGCCTGGCCATTAAC
TCCTGCGCCCTGGGCAATGGCGGCTGCCAGCACCATCTGTGTCAGCTCACAATCACTCGGCATCGCTGCCAGTGC
CGGCCCGGGTTCCAGCTCCAGGAGGACGGCAGGCATTGTGTCCGTAGAAGCCCGTGTGCCAACAGGAACGGCAGC
TGCATGCACAGGTGCCAGGTGGTCCGGGGCCTCGCCCGCTGTGAGTGCCACGTGGGCTATCAGCTAGCAGCGGAC
GGCAAGGCCTGTGAAGATGTGGACGAATGTGCCGCAGGGCTGGCCCAGTGTGCCCATGGCTGCCTCAACACCCAG
GGGTCCTTCAAGTGCGTGTGTCACGCGGGCTATGAGCTGGGCGCCGATGGCCGGCAGTGCTACCGTATTGAGATG
GAAATCGTGAACAGCTGTGAGGCCAACAACGGCGGCTGCTCCCATGGCTGCAGCCACACCAGTGCTGGGCCCCTG
TGCACCTGTCCCCGCGGCTACGAGCTGGACACAGATCAGAGGACCTGCATCAGATGTCGACGACTGTGCAGACAG
CCCGTGCTGCAGCAGGTGTGCACCAACAACCCTGGCGGGTACGAGTGCGGCTGCTACGCCGGCTACCGGCTCAGT
GCCGATGGCTGCGGCTGCGAGGATGTGGATGAGTGCGCCTCCAGCCGTGGCGGCTGCGAGCACCACTGCACCAAC
CTGGCCGGCTCCTTCCAGTGCTCCTGCGAGGCCGGCTACCGGCTGCACGAGGACCGTAGGGGCTGCAGCGCCCTG
GAGGAGCCGATGGTGGACCTGGACGGCGAGCTGCCTTTCGTGCGGCCCCTGCCCCACATTGCCGTGCTCCAGGAC
GAGCTGCCGCAACTCTTCCAGGATGACGACGTCGGGGCCGATGAGGAAGAGGCAGAGTTGCGGGGCGAACACACG
CTCACAGAGAAGTTTGTCTGCCTGGATGACTCCTTTGGCCATGACTGCAGCTTGACCTGTGATGACTGCAGGAAC
GGAGGGACCTGCCTCCTGGGCCTGGATGGCTGTGATTGCCCCGAGGGCTGGACTGGGCTCATCTGCAATGAGAGT
TGTCCTCCGGACACCTTTGGGAAGAACTGCAGCTTCTCCTGCAGCTGTCAGAATGGTGGGACCTGCGACTCTGTC
ACGGGGGCCTGCCGCTGCCCCCCGGGTGTCAGTGGAACTAACTGTGAGGATGGCTGCCCCAAGGGCTACTATGGC
AAGCACTGTCGCAAGAAATGCAACTGTGCCAACCGGGGCCGGTGCCACCGCCTCTACGGGGCCTGCCTCTGCGAC
CCAGGGCTCTACGGCCGCTTCTGCCACCTCGCCTGCCCGCCGTGGGCCTTTGGGCCGGGCTGCTCGGAGGAGTGC
CAGTGTGTGCAGCCCCACACGCAGTCCTGTGACAAGAGGGATGGCAGCTGCTCCTGCAAGGCTGGCTTCCGGGGC
GAGCGCTGTCAGGCAGAGTGTGAGCTGGGCTACTTTGGGCCGGGGTGCTGGCAGGCATGCACCTGCCCAGTGGGC
GTGGCCTGTGACTCCGTGAGCGGCGAGTGTGGGAAGCGGTGTCCTGCTGGCTTCCAGGGAGAGGACTGTGGCCAA
GAGTGCCCGGTGGGGACGTTTGGCGTGAACTGCTGAGCTCCTGCTCCTGTGGGGGGGCCCCCTGCCACGGGGTC
ACGGGGCAGTGCCGGTGTCCACCGGGGAGGACTGGGGAAGACTGTGAGGCAGATTGTCCCGAGGGCCGCTGGGGG
CTGGGCTGCCAGGAGATCTGCCCAGCATGCCAGCACGCTGCCCGCTGCGACCCTGAGACCGGAGCCTGCCTGTGC
CTCCCTGGCTTCGTCGGCAGCCGCTGCCAGGACGTGTGCCCAGCAGGCTGGTATGGTCCCAGCTGCCAGACAAGG
TGCTCTTGTGCCAATGATGAGCACTGCCACCCAGCCACCGGACACTGCAGCTGTGCCCCCGGGTGGACCGGCTTT
AGCTGCCAGAGAGCCTGTGATACTGGGCACTGGGGACCTGACTGCAGCCACCCCTGCAACTGCAGCGCTGGCCAC
GGGAGCTGTGATGCCATCAGCGGCCTGTGTCTGTGTGAGGCTGGCTACGTGGGCCCGCGGTGCGAGCAGCAGTGT
CCCCAGGGCCACTTTGGGCCCGGCTGTGAGCAGCTGTGCCAGTGTCAGCATGGAGCAGCCTGTGACCACGTCAGC
GGGGCCTGCACCTGCCCGGCCGGCTGGAGGGGCACCTTCTGCGAGCATGCCTGCCCGGCCGGCTTCTTTGGATTG
GACTGTCGTAGTGCCTGCAACTGCACCGCCGGAGCTGCCTGTGATGCCGTGAATGGCTCCTGCCTCTGCCCCGCT
GGCCGCCGGGGCCCCCGCTGTGCCGAGACCTGCCCTGCCGGCCTGTACGGCGACAACTGTCGGCATTCCTGCCTC
TGCCAGAACGGAGGGACCTGTGACCCTGTCTCAGGCCACTGTGCGTGCCCAGAGGGCTGGGCCGGCCTGGCCTGT
GAGAAGGAGTGCCCCCCCCGGGACGTCAGAGCTGGCTGCCGGCACAGCGGTGGTTGCCTCAACGGGGGCCTGTGT
GACCCGCACACGGGCCGCTGCCTCTGCCCAGCCGGCTGGGCTGGGGACAAGTGTCAGAGCCCCTGCCTGCGGGGC
TGGTTTGGAGAGGCCTGTGCCCAGCACTGCAGCTGCCCGCCTGGCGCTGCCTGCCACCACGTCACTGGGGCCTGC
CGCTGTCCCCCTGGCTTCACTGGCTCCGGCTGCGAGCAGGGATGTCCGCCCGGGCGGTATGGGCCAGGCTGTGAA
CAGCTGTGTGGGTGTCTCAACGGGGGCTCCTGTGATGCGGCCACGGGGGCCTGCCGCTGCCCCACTGGGTTCCTC
GGGACGGACTGCAACCTCACCTGTCCGCAGGGCCGCTTCGGCCCCAACTGCACCCACGTGTGTGGGTGTGGGCAG
GGGGCGGCCTGCGACCCTGTGACCGGCACCTGCCTCTGCCCCCGGGGAGAGCCGGCGTCCGCTGTGAGCGAGGC
TGCCCCCAGAACCGGTTTGGCGTGGGCTGCGAGCACACCTGCTCCTGCAGAAATGGGGGCCTGTGCCACGCCAGC
AACGGCAGCTGCTCCTGGCCTGGGCTGGACGGGGCGGCACTGCGAGCTGGCCTGTCCCCCTGGGCGCTACGGA
GCCGCCTGCCATCTGGAGTGCTCCTGCCACCAACAACAGCACGGGTGAGCCTGCCACGGGCACCTGCCGCTGCGGC
CCCGGCTTCTATGGCCAGGCCTGCGAGCACCCCTGTCCCCCTGGCTTCCACGGGGCTGGCTGCCAGGGGTTGTGC
TGGTGTCAACATGGAGCCCCTGCGACCCCATCAGTGGCCGATGCCTCTGCCCTGCCGGCTTCCACGGCCACTTC
TGTGAGAGGGGGTGTGAGCCAGGTTCATTTGGAGAGGGCTGCCACCAGCGCTGTGACTGTGACGGGGGGGCACCC
TGTGACCCTGTCACCGGTCTCTGCCTTTGCCCACCAGGGCGCTCAGGAGCCACCTGTAACCTGGATTGCAGAAGG
GGCCAGTTTGGGCCCAGCTGCACCCTGCACTGTGACTGCGGGGGTGGGCCTGACTGCGACCCTGTCAGTGGGCAG
TGTCACTGTGTGGATGGCTACATGGGGCCCACGTGCCGGGAAGGTGGGCCCTCCGGCTCCCCGAGAACCCGTCC
TTAGCCCAGGGCTCAGCGGGGCACACTGCCCGCCTCCAGCAGACCCACATCCCGGAGCGGTGGACCAGCGAGGCAC
TAG<u>TAGAGGCAGTCCCGTGGAGCCCGCCTCTCCAGTCCCAGCCAGAGGGGACCCTGGCCTTTGGTGACCACTGAG</u>
<u>AAGGACACTTCACGGGCCCAGAGCTCCTGGTACTGCCCTTCCTTTGAGGGCCGTGGAGGGCTGTGGACAGCCCAG</u>
<u>CAACCTGTCGCTCTTGGAGGCTGGTGTGGCCTTGAGGAGGGAAGCCTCGCATGGCCGCTGGAAGAGAGGCGCCTC</u>
<u>CTGGCCTGGCTCTGCAGAACCCAGGGGCACGCTCTGGGCCTGGGCTGAGGAAGTCCCGCTCTCCCCGCGGCTCTG</u>
<u>AGTTGGACTGAGGACAGGTGTGGGCGCCAGTGTGGGTGCAGGCGCAGGTGCAGGCACAGGGCCACTGTCCTCCAG</u>
<u>GCAGGCTT</u>

The NOV15c protein (SEQ ID NO:48) encoded by SEQ ID NO:47 is 1450 amino acid residues in length and is presented using the one-letter amino acid code in Table 15F. Although the SignalP, Psort and/or Hydropathy results indicate that NOV15c has a signal peptide and is likely to be localized in the mitochondrial matrix space with a certainty of 0.4753, the NOV15c protein disclosed here is similar to the EGF family, some members of which are released extracellularly. Alternatively, a NOV15c polypeptide is located to the cytoplasm with a certainty of 0.4500, the mitochondrial inner membrane with a certainty of 0.1802, or the mitochondrial intermembrane space with a certainty of 0.1802. The SignalP indicates a likely cleavage site for a NOV15c peptide is between positions 31 and 32, i.e., at the dash in the sequence GRG-AD.

TABLE 15F

Encoded NOV15c Protein Sequence (SEQ ID NO:48)

MPMGHSDRWSWRLLRLALPLPVWLPAGGGRGADSPCLCSRPHVCAEQELTLVGRRQPCVQALSHTVPVWKAGCGW
QAWCVGHERRTVYYMGYRQVYTTEARTVLRCCRGWTQQPDEEGCLSAECSASLCFHGGRCVPGSAQPCHCPPGFQ
GPRCQYDVDECRTHNGGCQHRCVNTPGSYLCECKPGFRLHTDSRTCLAINSCALGNGGCQHHCVQLTITRHRCQC
RPGFQLQEDGRHCVRRSPCANRNGSCMHRCQVVRGLARCECHVGYQLAADGKACEDVDECAAGLAQCAHGCLNTQ
GSFKCVCHAGYELGADGRQCYRIEMEIVNSCEANNGGCSHGCSHTSAGPLCTCPRGYELDTDQRTCIRCRRLCRQ
PVLQQVCTNNPGGYECGCYAGYRLSADGCGCEDVDECASSRGGCEHHCTNLAGSFQCSCEAGYRLHEDRRGCSAL
EEPMVDLDGELPFVRPLPHIAVLQDELPQLFQDDDVGADEEEAELRGEHTLTEKFVCLDDSFGHDCSLTCDDCRN
GGTCLLGLDGCDCPEGWTGLICNESCPPDTFGKNCSFSCSCQNGGTCDSVTGACRCPPGVSGTNCEDGCPKGYYG
KHCRKKCNCANRGRCHRLYGACLCDPGLYGRFCHLACPPWAFGPGCSEECQCVQPHTQSCDKRDGSCSCKAGFRG
ERCQAECELGYFGPGCWQACTCPVGVACDSVSGECGKRCPAGFQGEDCGQECPVGTFGVNCSSSCSCGGAPCHGV
TGQCRCPPGRTGEDCEADCPEGRWGLGCQEICPACQHAARCDPETGACLCLPGFVGSRCQDVCPAGWYGPSCQTR
CSCANDGHCHPATGHCSCAPGWTGFSCQRACDTGHWGPDCSHPCNCSAGHGSCDAISGLCLCEAGYVGPRCEQQC
PQGHFGPGCEQLCQCQHGAACDHVSGACTCPAGWRGTFCEHACPAGFFGLDCRSACNCTAGAACDAVNGSCLCPA
GRRGPRCAETCPAGLYGDNCRHSCLCQNGGTCDPVSGHCACPEGWAGLACEKECPPRDVRAGCRHSGGCLNGGLC
DPHTGRCLCPAGWAGDKCQSPCLRGWFGEACAQHCSCPPGAACHHVTGACRCPPGFTGSGCEQGCPPGRYGPGCE
QLCGCLNGGSCDAATGACRCPTGFLGTDCNLTCPQGRFGPNCTHVCGCGQGAACDPVTGTCLCPPGRAGVRCERG
CPQNRFGVGCEHTCSCRNGGLCHASNGSCSCGLGWTGRHCELACPPGRYGAACHLECSCHNNSTGEPATGTCRCG
PGFYGQACEHPCPPGFHGAGCQGLCWCQHGAPCDPISGRCLCPAGFHGHFCERGCEPGSFGEGCHQRCDCDGGAP
CDPVTGLCLCPPGRSGATCNLDCRRGQFGPSCTLHCDCGGGADCDPVSGQCHCVDGYMGPTCREGGPLRLPENPS
LAQGSAGTLPASSRPTSRSGGPARH

NOV15d

Alternatively, a NOV15 variant is NOV15d (alternatively referred to herein as CG56449-04), which includes the 877 nucleotide sequence (SEQ ID NO:49) shown in Table 15G. An open reading frame for the mature protein was identified beginning with an ATG codon at nucleotides 25–27 and ending with a TAG codon at nucleotides 535–537. Putative untranslated regions, if any, downstream from the termination codon and upstream from the initiation codon are underlined. The start and stop codons are in bold letters.

TABLE 15G

NOV15d Nucleotide Sequence (SEQ ID NO:49)

<u>CCGGAGCTGCCTGTGATGCCGTGA</u>ATGGCTCCTGCCTCTGCCCCGCTGGCCGCCGGGGCCCCCGCTGTGCCGAGA
CCTGCCCTGCCGGCCTGTACGGCGACAACTGTCGGCATTCCTGCCTCTGCCAGAACGGGAGGGACCTGTGACCCTG
TCTCAGGCCTGCGAGCACCCCTGTCCCCCTGGCTTCCACGGGGCTGGCCGCCAGGGGTTGTGCTGGTGTCAACAT
GGAGCCCCCTGCGACCCCATCAGTGGCCGATGCCTCTGCCCTGCCGGCTTCCACGGCCACTTCTGTGAGAGGGAT
TGCAGAAGGGGCCAGTTTGGGCCCAGCTGCACCCTGCACTGTGACTGCGGGGGTGGGGCTGACTGCGACCCTGTC
AGTGGGCAGTGTCACTGTGTGGATGGCTACATGGGGCCCACGTGCCGGGAAGGTGGGCCCCTCCGGCTCCCCGAG
AACCCGTCCTTAGCCCAGGGCTCAGCGGGCACACTGCCCGCCTCCAGCAGACCCACATCCCGGAGCGGTGGACCA
GCGAGGCACTAG<u>TAGAGGCAGTCCCGTGGAGCCCGCCTCTCCAGTCCCAGCCAGAGGGGACCCTGGCCTTTGGTG
ACCACTGAGAAGGACACTTCACGGGCCCAGAGCTCCTGGTACTGCCCTTCCTTTGAGGGCCGTGGAGGGCTGTGG
ACAGCCCAGCAACCTGTCGCTCTTGGAGGCTGGTGTGGCCTTGAGGAGGGAAGCCTCGCATGGCCGCTGGAAGAG
AGGCGTCTCCTGGCCTGGCTCTGCAGAACCCAGGGGCACGCTCTGGGCCTGGGCTGAGGAAGTCCCGCTCTCCCG
CGGCTCTGAGTTGGACTGAGGACAGGTGTGGGCGCCAGTGTGGGTGCAGGCG</u>

The NOV15d protein (SEQ ID NO:50) encoded by SEQ ID NO:49 is 170 amino acid residues in length and is presented using the one-letter amino acid code in Table 15H. The SignalP, Psort and/or Hydropathy results indicate that NOV15d has no known signal peptide and is likely to be localized in the cytoplasm with a certainty of 0.6500. Alternatively, a NOV15d polypeptide is located to the lysosome (lumen) with a certainty of 0.1853, or the mitochondrial matrix space with a certainty of 0.1000.

TABLE 15H

Encoded NOV15d Protein Sequence (SEQ ID NO:50)

MAPASAPLAAGAPAVPRPALPACTATTVGIPASARTEGPVTLSQACEHPCPPGFHGAGRQGLCWCQHGAPCDPIS
GRCLCPAGFHGHFCERDCRRGQFGPSCTLHCDCGGGADCDPVSGQCHCVDGYMGPTCREGGPLRLPENPSLAQGS
AGTLPASSRPTSRSGGPARH

NOV15e

Alternatively, a NOV15 variant is NOV15e (alternatively referred to herein as CG56449-06), which includes the 7334 nucleotide sequence (SEQ ID NO:51) shown in Table 15I. An open reading frame for the mature protein was identified beginning with an ATG codon at nucleotides 1–3 and ending with a TGA codon at nucleotides 4210–4212. Putative untranslated regions, if any, downstream from the termination codon and upstream from the initiation codon are underlined. The start and stop codons are in bold letters.

TABLE 15I

NOV15e Nucleotide Sequence (SEQ ID NO:51)

ATGCCCATGGGACATTCTGACAGGTGGTCTTGGCGTCTCCTGAGGCTGGCACTGCCACTCCCAGTCTGGTTGCCG
GCTGGGGGTGGCCGAGGCGCTGACTCTCCATGTCTCTGTTCCAGGCCCCACGTGTGTGCTGAGCAGGAGCTGACC
CTGGTGGGCCGCCGCCAGCCGTGCGTGCAGGCCTTAAGCCACACGGTGCCGGTGTGGAAGGCCGGCTGTGGGTGG
CAGGCGTGGTGCGTGGGTCATGAGCGGAGGACCGTCTACTACATGGGCTACAGGCAGGTGTATACCACGGAGGCC
CGGACCGTGCTCAGGTGCTGCCGAGGGTGGATGCAGCAGCCCGACGAGGAGGGCTGCCTCTCGGATGTGGGTGAG
TGTGCCAACGCCAACGGGGGCTGTGCGGGTCGGTGCCGGGACACCGTGGGGGGCTTCTACTGCCGCTGGCCCCCC
CCCAGCCACCAGCTGCAGGGTGATGGCGAGACTTGCCAAGATGTGGACGAATGCCGAACCCACAACGGTGGCTGC
CAGCACCGGTGCGTGAACACCCCAGGCTCCTACCTCTGTGAGTGCAAGCCCGGCTTCCGGCTCCACACTGACAGC
AGGACCTGCGCCATTAACTCCTGCGCCCTGGGCAATGGCGGCTGCCAGCACCACTGTGTCCAGCTCACAATCACT
CGGCATCGCTGCCAGTGCCGGCCCGGGTTCCAGCTCCAGGAGGACGGCAGGCATTGTGTCCGTAGAAGCCCGTGT
GCCAACAGGAACGGCAGCTGCATGCACAGGTGCCAGGTGGTCGGGGGCCTCGCCCGCTGTGAGTGCCACGTGGGC
TATCAGCTAGCAGCGGACGGCAAGGCCTGTGAAGATGTGGACGAATGTGCCGCAGGGCTGGCCCAGTGTGCCCAT
GGCTGCCTCAACACCCAGGGGTCCTTCAAGTGCGTGTGTCACGCGGGCTATGAGCTGGGCGCCGATGGCCGGCAG
TGCTACCGTATTGAGATGGAAATCGTGAACAGCTGTGAGGCCAACAACGGCGGCTGCTCCCATGGCTGCAGCCAC
ACCAGTGCTGGGCCCTGTGCACCTGTCCCCGCGGCTACGAGCTGGACACAGATCAGAGGACCTGCATCAGATGT
CGACGACTGTGCAGACAGCCCGTGCTGCAGCAGGTGTGCACCAACAACCCTGGCGGGTACGAGTGCGGCTGCTAC
GCCGGCTACCGGCTCAGTGCCGATGGCTGCGGCTGCGAGGATGTGGATGAGTGCGCCTCCAGCCGTGGCGGCTGC
GAGCACCACTGCACCAACCTGGCCGGCTCCTTCCAGTGCTCCTGCGAGGCCGGCTACCGGCTGCACGAGGACCGT
AGGGGCTGCAGCGCCCTGGAGGAGCCGATGGTGGACCTGGACGGCGAGCTGCCTTTCGTGCGGCCCCTGCCCCAC
ATTGCCGTGCTCCAGGACGAGCTGCCGCAACTCTTCCAGGATGACGACGTCGGGGCCGATGAGGAAGAGGCAGAG
TTGCGGGGCGAACACACGCTCACAGAGAAGTTTGTCTGCCTGGATGACTCCTTTGGCCATGACTGCAGCTTGACC
TGTGATGACTGCAGGAACGGAGGGACCTGCCTCCTGGGCCTGGATGGCTGTGATTGCCCCCGAGGGCTGGACTGGG
CTCATCTGCAATGAGAGTTGTCCTCCGGACACCTTTGGGAAGAACTGCAGCTTCTCCTGCAGCTGTCAGAATGGT
GGGACCTGCGACTCTGTCACGGGGGCCTGCCGCTGCCCCCCGGGTGTCAGTGGAACTAACTGTGAGGATGGCTGC
CCCAAGGGCTACTATGGCAAGCACTGTCGCAAGAAATGCAACTGTGCCAACCGGGGCCGGTGCCACCGCCTCTAC
GGGGCCTGCCTCTGCGACCCAGGGCTCTACGGCCGCTTCTGCCACCTCGCCTGCCCGCCGTGGGCCTTTGGGCCG
GGCTGCTCGGAGGAGTGCCAGTGTGTGCAGCCCCACACGCAGTCCTGTGACAAGAGGGATGGCAGCTGCTCCTGC
AAGGCTGGCTTCCGGGGCGAGCGCTGTCAGGCAGAGTGTGAGCCGGGCTACTTTGGGCCGGGGTGCTGGCAGGCA
TGCACCTGCCCAGTGGGCGTGGCCTGTGACTCCGTGAGCGGCGAGTGTGGGAAGCGGTGTCCTGCTGGCTTCCAG
GGAGAGGACTGTGGCCAAGAGTGCCCGGTGGGGACCTTTGGCGTGAACTGCTGAGCTCCTGCTCCTGTGGGGGG
GCCCCCTGCCACGGGGTCACGGGGCAGTGCCGGTGTCCGCCGGGGAGGACTGGGGAAGACTGTGAGGCAGGTGAG
TGTGAGGGCCTCTGGGGGCTGGGCTGCCAGGAGATCTGCCCAGCATGCCATAACGCTGCTCGCTGCGACCCTGAG
ACCGGAGCCTGCCTGTGCCTCCCTGGCTTTGTCGGCAGCCGCTGCCAGGACTGTGAGGCAGGCTGGTATGGTCCC
AGCTGCCAGACAATGTGCTCTTGTGCCAATGATGGGCACTGCCACCAAGACACGGGACACTGCAGCTGTGCCCCC
GGGTGGACCGGCTTTAGCTGCCAGAGAGCCTGTGATACTGGGCACTGGGGACCTGACTGCAGCCACCCCTGCAAC
TGCAGCGCTGGCCACGGGAGCTGTGATGCCATCAGCGGCCTGTGTCTGTGTGAGGCTGGCTACGTGGGCCCGCGG
TGCGAGCAGTCAGAGTGTCCCCAGGGCCACTTTGGGCCCGGCTGTGAGCAGCGGTGCCAGTGTCAGCATGGAGCA
GCCTGTGACCACGTCAGCGGGGCCTGCACCTGCCCGGCCGGCTGGAGGGGCACCTTCTGCGAGCATGCCTGCCCG
GCCGGCTTCTTTGGATTGGACTGTCGCAGTGCCTGCAACTGCACCGCCGGAGCTGCCTGTGATGCCGTGAATGGC
TCCTGCCTCTGCCCCGCTGGCCGCCGGGGCCCCGCTGTGCCGAGACCTGCCCAGCCCACACCTACGGGCACAAT
TGCAGCCAGGCCTGTGCCTGCTTTAACGGGGCCTCCTGTGACCCTGTCCACGGGCAGTGCCACTGTGCCCCTGGC
TGGATGGGGCCCTCCTGCCTGCAGGCCTGCCCTGCCGGCCTGTACGGCGACAACTGTCGGCATTCCTGCCTCTGC
CAGAACGGAGGGACCTGTGACCCTGTCTCAGGCCACTGTGCGTGCCCAGAGGGCTGGGCCGGCCTGGCCTGTGAG
GTAGAGTGCCTCCCCCGGGACGTCAGAGCTGGCTGCCGGCACAGCGGCGGTTGCCTCAACGGGGGCCTGTGTGAC
CCGCACACGGGCCGCTGCCTCTGCCCAGCCGGCTGGACTGGGGACAAGTGTCAGAGCCCTGCAGCCTGTGCCAAG

TABLE 15I-continued

NOV15e Nucleotide Sequence (SEQ ID NO:51)

GGCACATTCGGGCCTCACTGTGAGGGGCGCTGTGCCTGCCGGTGGGGAGGCCCCTGCCACCTTGCCACCGGGGCC
TGCCTCTGCCCTCCGGGGTGGCGGGGGCCTCATCTTTCTGCAGCCTGCCTGCGGGGCTGGTTTGGAGAGGCCTGT
GCCCAGCGCTGCAGCTGCCCGCCTGGCGCTGCCTGCCACCACGTCACTGGGGCCTGCCGCTGTCCCCCTGGCTTC
ACTGGCTCCGGCTGCGAGCAGGCCTGCCCACCCGGCAGCTTTGGGGAGGACTGTGCGCAGATGTGCCAGTGTCCC
GGTGAGAACCCGGCCTGCCACCCTGCCACCGGGACCTGCTCATGTGCTGCTGGCTACCACGGCCCCAGCTGCCAG
CAACGATGTCCGCCCGGGCGGTATGGGCCAGGCTGTGAACAGCTGTGTGGGTGTCTCAACGGGGGCTCCTGTGAT
GCGGCCACGGGGGCCTGCCGCTGCCCCACTGGGTTCCTCGGGACGGACTGCAACCTCACCTGTCCGCAGGGCCGC
TTCGGCCCCAACTGCACCCACGTGTGTGGGTGTGGGCAGGGGGCGGCCTGCGACCCTGTGACCGGCACCTGCCTC
TGCCCCCCGGGGAGAGCCGGCGTCCGCTGTCAGCGAGGCTGCCCCCAGAACCGGTTTGGCGTGGGCTGCGAGCAC
ACCTGCTCCTGCAGAAATGGGGGCCTGTGCCACGCCAGCAAGCGGCAGCTGCTCCTGTGGCCTGGGCTGGACGGG
GCGGCACTGCGAGCTGGCCTGTCCCCCTGGGCGCTACGGAGCCGCCTGCCATCTGGAGTGCTCCTGCCACAACAA
CAGCACGTGTGAGCCTGCCACGGGCACCTGCCGCTGCGGCCCCGGCTTCTATGGCCAGGCCTGCGAGCACCCCTG
TCCCCCTGGCTTCCACGGGGCTGGCTGCCAGGGGTTGTGCTGGTGTCAACATGGAGCCCCCTGCGACCCCATCAG
TGGCCGATGCCTCTGCCCTGCCGGCTTCCACGGCCCACTTCTGTGAGAGGGGGTGTGAGCCAGGTTCATTTGGAGA
GGGCTGCCACCAGCGCTGTGACTGTGACGGGGGGGCACCCTGTGACCCTGTCACCGGTCTCTGCCTTTGCCCACC
AGGGCGCTCAGGAGCCACCTGTAACCTGGATTGCAGAAGGGGCCAGTTTGGGCCCAGCTGCACCCTGCACTGTGA
CTGCGGGGTGGGGCTGACTGCGACCCTGTCAGTGGGCAGTGTCACTGTGTGGATGGCTACATGGGGCCCACGTG
CCGGGAAGGTGGGCCCCTCCGGCTCCCCGAGAACCCGTCCTTAGCCCAGGGCTCAGCGGGCACACTGCCCGCCTC
CAGCAGACCCACATCCCGGAGCGGTGGACCAGCGAGGCACTAGTAGAGGCAGTCCCGTGGAGCCCGCCTCTCCAG
TCCCAGCCAGAGGGGACCCTGGCCTTTGGTGACCACTGAGAAGGACACTTCACGGGCCCAGAGCTCCTGGTACTG
CCCTTCCTTTGAGGGCCGTGGAGGGCTGTGGACAGCCCAGCAACCTGTCGCTCTTGGAGGCTGGTGTGGCCTTGA
GGAGGGAAGCCTCGCATGGCCGCTGGAAGAGAGGCGCCTCCTGGCCTGGCTCTGCAGAACCCAGGGGCACGCTCT
GGGCCTGGGCTGAGGAAGTCCCGCTCTCCCCGCGGCTCTGAGTTGGACTGAGGACAGGTGTGGGCGCCAGTGTGG
GTGCAGGCGCAGGTGCAGGCACAGGGCCACTGTCCTCCAGGCAGGCTTTTTGGTGCTAGGCCCTGGGACTGGAAG
TCGCCCAGCCCGTATTTATGTAAAGGTATTTATGGGCCACTGCACATGCCCGCTGCAGCCCTGGGATCAGCTGGA
AGCTGCCTGTCATCTCCTGCCCAATCCCCAGAAACCCTGATTCAGGTCTGCAGGCTCCTGCGGGCTCACCAGGCT
GCTGGCTCCGGTACCATGTAAACCTAGGAAGGTAAAGGAGCAGGCAACCTCCTCGTGGCCTGTGTGTTTGCTGTG
TTACGTGGACTCTGTGTGGGCTCCTCCCTGGGGCCCGGCCAGCATAACGGTGCACCCAGGGACCTCCCAGTGCAC
CCGGGGCCCTTTGCAGGGGTGGGGGTGCCACACAAGTGAAGAAGTTGGGACTCATCTCAGTTCCCAGTGCTATTG
AGGAGAACGCTGGGGCTGCATTCATTACCGCTGAGACCCAGAGACTGGCTGTTCCCAGAGAATGGCCCAGGGGGA
GGAGGGCTGTGTGGAGGGGCAACCTGGACTGAGGCCGAACTCCCTTGGGCTCACCCCACCCACCCCTACCTGAG
CATCAGCAGTGGGGGGAGGGCAGCATCGCAGGGGCAGGGACTCCCTGGGTGAGGACAGACCAGCCCTCCCGAGCA
CCTGGCACTCATGGGCTGAGGCTGACTTCTCCTGGAAGAAGGGCCCAGAGTGGAAGGAAGAGGCAGAGGGTAGAG
GTGGTGGCTGGGGGCTCCTCTGCAGAGTGGGGTGGCCAATGGAGAGGGCTGCACTCACACCGCAACATAGGACTC
TCTCTCCCTTAAGAAGGCCCCCTTAGGGTCTGGGCTGCCGCCCCCATCACCCTAAAACCAGCCAAGGTAGCTGAG
GCCCCAGGGCAGACAATTTCACCAGCAGGANGAGGAGGAGTCCAGTGAGCTTGGTTGCTCACAGACAGCAAGGGA
GCTGTCACAGAGGAAGCTGATGAATGGACCGCTGTGGGGAGACTTTAAAGTAGAACAGTGATAAGGGAGGGCAGG
ATGGTGGGGATGCAGAAGCAGCAGCCAGAGAGAGACGGACTGGGGTGCAGACGGAGTGTGGAAAACGCATACCTT
GAAATGAAGCATCCAGCAGATGGGGTGAGTGGATACAGCTCAGGAGATTCTCCCAGGAATAGCAGGGAGGCGTAA
AGAGAGACAACGTACAGAGATAGATGAATGGAAATGGGTAAGGGAGGTGTTCATTCACATCCATCTAACTGCAAA
ATACAAAAGTAAGAAGTCATTGACATGAAGCAACGACGACCAAGACGTTCTCAGATCTAAAGGTGAATGATCTCA
GTCAGCCTGGAAATGCACAAGGTGGAAAAATAACATAAAAAAGCCATAAGACCTTGAAGAACATCAATGTCAAAG
ATAAATTCTAAAGTCCCAGAGAAAAAAAGAATGGGAATCAAATTGACCTCAGACTATACGTGAGAAACCGGAGAG
CCAGAAAACTGTGATGTTCCATCCTCAGAGTTTGAAGGAAATATTTGAAGGCTGAATTTTACATCCAGCTAAACT
ATCAAAGGCATGCAAAGTCCATGTTATTCTTAGGCCTTCAAGGCCTCGGCCATTTTTCTACAGAAAAGCCTGATT
TTAAAATGCTCTTAGAGACGTTCTCCAGCCAGAAGAGAAAGAAGCCAGGAGGGTGCTCTGAGATATTCAGTCACC
ACAGTTCCCAAATGGCCTAGGAATTCAGAGAGTCAGAATATCACCATTACTCCCCAATGGGAACCCCCGACAGTC
TCAGCATGGTGTGAGGGTGTGGACGGGGGGCCTGGCAGGTACCAATCACTCATCCCGCTCCAGTGAAGACACAGTG
TTCAGCTACGGAAGCCATAAGGCAGGCCGAGCTTCTGCCCATCCGGAGGAAATCTCAGCTATCCAACGGCGGTCA
GGAGCAGAGGAAAATAAAGCAGAATAACTAGAAAACACGCTCACAGATCCTAATGTTAACGGTTACAAATGACGA
CGGAAAAACAAACTCCTGACCATATATTATATAGTTTCAAGCAGCAAGAAGGAGGATATTGAACATTCTCAACAC
ACATAATAAACGCTTGAGATGATGATATGCTCATTACCCTGATTTGATCACTAGACATNCCATGTATCAAAACAT
CACTGTGTATCCGATGAATATCTACAATTATTGTCAATTAAAAACATCATTAAAAACAA

The NOV15e protein (SEQ ID NO:52) encoded by SEQ ID NO:51 is 1403 amino acid residues in length and is presented using the one-letter amino acid code in Table 15J. Although the SignalP, Psort and/or Hydropathy results indicate that NOV15e has a signal peptide and is likely to be localized in the mitochondrial matrix space with a certainty of 0.4753, the NOV15 e protein disclosed here is similar to the EGF family, some members of which are released extracellularly. Alternatively, a NOV15e polypeptide is located to the microbody (peroxisome) with a certainty of 0.3000, the mitochondrial inner membrane with a certainty of 0.1802, or the mitochondrial intermembrane space with a certainty of 0.1802. The SignalP indicates a likely cleavage site for a NOV15e peptide is between positions 31 and 32, i.e., at the dash in the sequence GRG-AD.

TABLE 15J

Encoded NOV15e Protein Sequence (SEQ ID NO:52)

MPMGHSDRWSWRLLRLALPLPVWLPAGGGRGADSPCLCSRPHVCAEQELTLVGRRQPCVQALSHTVPVWKAGCGW
QAWCVGHERRTVYYMGYRQVYTTEARTVLRCCRGWMQQPDEEGCLSDVGECANANGGCAGRCRDTVGGFYCRWPP
PSHQLQGDGETCQDVDECRTHNGGCQHRCVNTPGSYLCECKPGFRLHTDSRTCAINSCALGNGGCQHHCVQLTIT
RHRCQCRPGFQLQEDGRHCVRRSPCANRNGSCMHRCQVVRGLARCECHVGYQLAADGKACEDVDECAAGLAQCAH
GCLNTQGSFKCVCHAGYELGADGRQCYRIEMEIVNSCEANNGGCSHGCSHTSAGPLCTCPRGYELDTDQRTCIRC

TABLE 15J-continued

Encoded NOV15e Protein Sequence (SEQ ID NO:52)

RRLCRQPVLQQVCTNNPGGYECGCYAGYRLSADGCGCEDVDECASSRGGCEHHCTNLAGSFQCSCEAGYRLHEDR
RGCSALEEPMVDLDGELPFVRPLPHIAVLQDELPQLFQDDDVGADEEEAELRGEHTLTEKFVCLDDSFGHDCSLT
CDDCRNGGTCLLGLDGCDCPEGWTGLICNESCPPDTFGKNCSFSCSCQNGGTCDSVTGACRCPPGVSGTNCEDGC
PKGYYGKHCRKKCNCANRGRCHRLYGACLCDPGLYGRFCHLACPPWAFGPGCSEECQCVQPHTQSCDKRDGSCSC
KAGFRGERCQAECEPGYFGPGCWQACTCPVGVACDSVSGECGKRCPAGFQGEDCGQECPVGTFGVNCSSSCSCGG
APCHGVTGQCRCPPGRTGEDCEAGECEGLWGLGCQEICPACHNAARCDPETGACLCLPGFVGSRCQDCEAGWYGP
SCQTMCSCANDGHCHQDTGHCSCAPGWTGFSCQRACDTGHWGPDCSHPCNCSAGHGSCDAISGLCLCEAGYVGPR
CEQSECPQGHFGPGCEQRCQCQHGAACDHVSGACTCPAGWRGTFCEHACPAGFFGLDCRSACNCTAGAACDAVNG
SCLCPAGRRGPRCAETCPAHTYGHNCSQACACFNGASCDPVHGQCHCAPGWMGPSCLQACPAGLYGDNCRHSCLC
QNGGTCDPVSGHCACPEGWAGLACEVECLPRDVRAGCRHSGGCLNGGLCDPHTGRCLCPAGWTGDKCQSPAACAK
GTFGPHCEGRCACRWGGPCHLATGACLCPPGWRGPHLSAACLRGWFGEACAQRCSCPPGAACHHVTGACRCPPGF
TGSGCEQACPPGSFGEDCAQMCQCPGENPACHPATGTCSCAAGYHGPSCQQRCPPGRYGPGCEQLCGCLNGGSCD
AATGACRCPTGFLGTDCNLTCPQGRFGPNCTHVCGCGQGAACDPVTGTCLCPPGRAGVRCERGCPQNRFGVGCEH
TCSCRNGGLCHASKRQLLLWPGLDGAALRAGLSPWALRSRLPSGVLLPQQQHV

NOV15f

Alternatively, a NOV15 variant is NOV15f (alternatively referred to herein as CG56449-08), which includes the 4835 nucleotide sequence (SEQ ID NO:53) shown in Table 15K. An open reading frame for the mature protein was identified beginning with an ATG codon at nucleotides 1–3 and ending with a TAG codon at nucleotides 4732–4734. Putative untranslated regions, if any, downstream from the termination codon and upstream from the initiation codon are underlined. The start and stop codons are in bold letters.

TABLE 15K

NOV15f Nucleotide Sequence (SEQ ID NO: 53)

ATGTCGTTCCTTGAAGAGGCGAGGGCAGCGGGGCGCGCGGTGGTCCTGGCGTTGGTGCTGCTGCTGCTCCCCGCC

GTGCCCGTGGGCGCCAGCGTTCCGCCGCGGCCCCTGCTCCCGCTGCAGCCCGGCATGCCCCACGTGTGTGCTGAG

CAGGAGCTGACCCTGGTGGGCCCCCGCCAGCCGTGCGTGCAGGCCTTAAGCCACACGGTGCCGGTGTGGAAGGCC

GGCTGTGGGTGGCAGGCGTGGTGCGTGGGTCATGAGCGGAGGACCGTCTACTACATGGGCTACAGGCAGGTGTAT

ACCACGGAGGCCCGGACCGTGCTCAGGTGCTGCCGAGGGTGGATGCAGCAGCCCGACGAGGAGGGCTGCCTCTCG

GATGTGGGTGAGTGTGCCAACGCCAACGGGGGCTGTGCGGGTCGGTGCCGGGACACCGTGGGGGGCTTCTACTGC

CGCTGGCCCCCCCCCAGCCACCAGCTGCAGGGTGATGGCGAGACTTGCCAAGATGTGGACGAATGCCGAACCCAC

AACGGTGGCTGCCAGCACCGGTGCGTGAACACCCCAGGCTCCTACCTCTGTGAGTGCAAGCCCGGCTTCCGGCTC

CACACTGACAGCAGGACCTGCGCCATTAACTCCTGCGCCCTGGGCAATGGCGGCTGCCAGCACCACTGTGTCCAG

CTCACAATCACTCGGCATCGCTGCCAGTGCCGGCCCGGGTTCCAGCTCCAGGAGGACGGCAGGCATTGTGTCCGT

AGAAGCCCGTGTGCCAACAGGAACGGCAGCTGCATGCACAGGTGCCAGGTGGTCCGGGGCCTCGCCCGCTGTGAG

TGCCACGTGGGCTATCAGCTAGCAGCGGACGGCAAGGCCTGTGAAGATGTGGACGAATGTGCCGCAGGGCTGGCC

CAGTGTGCCCATGGCTGCCTCAACACCCAGGGGTCCTTCAAGTGCGTGTGTCACGCGGGCTATGAGCTGGGCGCC

GATGGCCGGCAGTGCTACCGTATTGAGATGGAAATCGTGAACAGCTGTGAGGCCAACAACGGCGGCTGCTCCCAT

GGCTGCAGCCACACCAGTGCTGGGCCCCTGTGCACCTGTCCCCGCGGCTACGAGCTGGACACAGATCAGAGGACC

TGCATCAGATGTCGACGACTGTGCAGACAGCCCGTGCTGCAGCAGGTGTGCACCAACAACCCTGGCGGGTACGAG

TGCGGCTGCTACGCCGGCTACCGGCTCAGTGCCGATGGCTGCGGCTGCGAGGATGTGGATGAGTGCGCCTCCAGC

CGTGGCGGCTGCGAGCACCACTGCACCAACCTGGCCGGCTCCTTCCAGTGCTCCTGCGAGGCCGGCTACCGGCTG

CACGAGGACCGTAGGGGCTGCAGCGCCCTGGAGGAGCCGATGGTGGACCTGGACGGCGAGCTGCCTTTCGTGCGG

CCCCTGCCCCACATTGCCGTGCTCCAGGACGAGCTGCCGCAACTCTTCCAGGATGACGACGTCGGGGCCGATGAG

GAAGAGGCAGAGTTGCGGGGCGAACACACGCTCACAGAGAAGTTTGTCTGCCTGGATGACTCCTTTGGCCATGAC

TGCAGCTTGACCTGTGATGACTGCAGGAACGGAGGGACCTGCCTCCTGGGCCTGGATGGCTGTGATTGCCCCGAG

GGCTGGACTGGGCTCATCTGCAATGAGAGTTGTCCTCCGGACACCTTTGGGAAGAACTGCAGCTTCTCCTGCAGC

TGTCAGAATGGTGGGACCTGCGACTCTGTCACGGGGGCCTGCCGCTGCCCCCCGGGTGTCAGTGGAACTAACTGT

TABLE 15K-continued

NOV15f Nucleotide Sequence (SEQ ID NO: 53)

```
GAGGATGGCTGCCCCAAGGGCTACTATGGCAAGCACTGTCGCAAGAAATGCAACTGTGCCAACCGGGGCCGGTGC
CACCGCCTCTACGGGGCCTGCCTCTGCGACCCAGGGCTCTACGGCCGCTTCTGCCACCTCGCCTGCCCGCCGTGG
GCCTTTGGGCCGGGCTGCTCGGAGGAGTGCCAGTGTGTGCAGCCCCACACGCAGTCCTGTGACAAGAGGGATGGC
AGCTGCTCCTGCAAGGCTGGCTTCCGGGGCGAGCGCTGTCAGGCAGAGTGTGAGCCGGGCTACTTTGGGCCGGGG
TGCTGGCAGGCATGCACCTGCCCAGTGGGCGTGGCCTGTGACTCCGTGAGCGGCGAGTGTGGGAAGCGGTGTCCT
GCTGGCTTCCAGGGAGAGGACTGTGGCCAAGAGTGCCCGGTGGGGACCTTTGGCGTGAACTGCTCGAGCTCCTGC
TCCTGTGGGGGGCCCCCTGCCACGGGGTCACGGGGCAGTGCCGGTGTCCGCCGGGGAGGACTGGGGAAGACTGT
GAGGCAGGTGAGTGTGAGGGCCTCTGGGGGCTGGGCTGCCAGGAGATCTGCCCAGCATGCCATAACGCTGCTCGC
TGCGACCCTGAGACCGGAGCCTGCCTGTGCCTCCCTGGCTTTGTCGGCAGCCGCTGCCAGGACTGTGAGGCAGGC
TGGTATGGTCCCAGCTGCCAGACAATGTGCTCTTGTGCCAATGATGGGCACTGCCACCAAGACACGGGACACTGC
AGCTGTGCCCCGGGTGGACCGGCTTTAGCTGCCAGAGAGCCTGTGATACTGGGCACTGGGGACCTGACTGCAGC
CACCCCTGCAACTGCAGCGCTGGCCACGGGAGCTGTGATGCCATCAGCGGCCTGTGTCTGTGTGAGGCTGGCTAC
GTGGGCCCGCGGTGCGAGCAGTCAGAGTGTCCCCAGGGCCACTTTGGGCCCGGCTGTGAGCAGCGGTGCCAGTGT
CAGCATGGAGCAGCCTGTGACCACGTCAGCGGGGCCTGCACCTGCCCGGCCGGCTGGAGGGGCACCTTCTGCGAG
CATGCCTGCCCGGCCGGCTTCTTTGGATTGGACTGTCGCAGTGCCTGCAACTGCACCGCCGGAGCTGCCTGTGAT
GCCGTGAATGGCTCCTGCCTCTGCCCCGCTGGCCGCCGGGGCCCCGCTGTGCCGAGAGTGCCTGCCCAGCCCAC
ACCTACGGGCACAATTGCAGCCAGGCCTGTGCCTGCTTTAACGGGGCCTCCTGTGACCCTGTCCACGGGCAGTGC
CACTGTGCCCCTGGCTGGATGGGGCCCTCCTGCCTGCAGGCCTGCCCTGCCGGCCTGTACGGCGACAACTGTCGG
CATTCCTGCCTCTGCCAGAACGGAGGGACCTGTGACCCTGTCTCAGGCCACTGTGCGTGCCCAGAGGGCTGGGCC
GGCCTGGCCTGTGAGGTAGAGTGCCTCCCCCGGGACGTCAGAGCTGGCTGCCGGCACAGCGGCGGTTGCCTCAAC
GGGGGCCTGTGTGACCCGCACACGGGCCGCTGCCTCTGCCCAGCCGGCTGGACTGGGGACAAGTGTCAGAGCCCT
GCAGCCTGTGCCAAGGGCACATTCGGGCCTCACTGTGAGGGGCGCTGTGCCTGCCGGTGGGGAGGCCCCTGCCAC
CTTGCCACCGGGGCCTGCCTCTGCCCTCCGGGGTGGCGGGGCCTCATCTTTCTGCAGCCTGCCTGCGGGCTGG
TTTGGAGAGGCCTGTGCCCAGCGCTGCAGCTGCCCGCCTGGCGCTGCCTGCCACCACGTCACTGGGGCCTGCCGC
TGTCCCCCTGGCTTCACTGGCTCCGGCTGCGAGCAGGCCTGCCCACCCGGCAGCTTTGGGGAGGACTGTGCGCAG
ATGTGCCAGTGTCCCGGTGAGAACCCGGCCTGCCACCCTGCCACCGGGACCTGCTCATGTGCTGCTGGCTACCAC
GGCCCCAGCTGCCAGCAACGATGTCCGCCCGGCGGTATGGGCCAGGCTGTGAACAGCTGTGTGGGTGTCTCAAC
GGGGGCTCCTGTGATGCGGCCACGGGGCCTGCCGCTGCCCCACTGGGTTCCTCGGGACGGACTGCAACCTCACC
TGTCCGCAGGGCCGCTTCGGCCCCAACTGCACCCACGTGTGTGGGTGTGGGCAGGGGCCGGCCTGCGACCCTGTG
ACCGGCACCTGCCTCTGCCCCCCGGGGAGAGCCGGCGTCCGCTGTGAGCGAGGCTGCCCCCAGAACCGGTTTGGC
GTGGGCTGCGAGCACACCTGCTCCTGCAGAAATGGGGGCCTGTGCCACGCCAGCAACGGCAGCTGCTCCTGTGGC
CTGGGCTGGACGGGCGGCACTGCGAGCTGGCCTGTCCCCTGGGCGCTACGGAGCCGCCTGCCATCTGGAGTGC
TCCTGCCACAACAACAGCACGTGTGAGCCTGCCACGGGCACCTGCCGCTGCGGCCCCGGCTTCTATGGCCAGGCC
TGCGAGCACCCCTGTCCCCCTGGCTTCCACGGGGCTGGCTGCCAGGGGTTGTGCTGGTGTCAACATGGAGCCCCC
TGCGACCCCATCAGTGGCCGATGCCTCTGCCCTGCCGGCTTCCACGCCACTTCTGTGAGAGGGGGTGTGAGCCA
GGTTCATTTGGAGAGGGCTGCCACCAGCGCTGTGACTGTGACGGGGGGCACCCTGTGACCCTGTCACCGGTCTC
TGCCTTTGCCCACCAGGGCGCTCAGGAGCCACCTGTAACCTGGATTGCAGAAGGGGCCAGTTTGGGCCCAGCTGC
ACCCTGCACTGTGACTGCGGGGGTGGGCTGACTGCGACCCTGTCAGTGGGCAGTGTCACTGTGTGGATGGCTAC
```

TABLE 15K-continued

NOV15f Nucleotide Sequence (SEQ ID NO: 53)

ATGGGGCCCACGTGCCGGGAAGCGGGCACACTGCCCGCCTCCAGCAGACCCACATCCCGGAGCGGTGGACCAGCG

AGGCACTAGTAGAGGCAGTCCCGTGGAGCCCGCCTCTCCAGTCCCAGCCAGAGGGGACCCTGGCCTTTGGTGACC

ACTGAGAAGGACACTTCACGGGCCCAGAGCTCCTG

The NOV15f protein (SEQ ID NO:54) encoded by SEQ ID NO:53 is 1577 amino acid residues in length and is presented using the one-letter amino acid code in Table 15L.

indicates a likely cleavage site for a NOV15f peptide is between positions 30 and 31, i.e., at the dash in the sequence VGA-SV.

TABLE 15L

Encoded NOV15f Protein Sequence (SEQ ID NO: 54)

MSFLEEARAAGRAVVLALVLLLLPAVPVGASVPPRPLLPLQPGMPHVCAEQELTLVGRRQPCVQALSHTVPVWKA

GCGWQAWCVGHERRTVYYMGYRQVYTTEARTVLRCCRGWMQQPDEEGCLSDVGECANANGGCAGRCRDTVGGFYC

RWPPPSHOLOGDGETCQDVDECRTHNGGCQHRCVNTPGSYLCECKPGFRLHTDSRTCAINSCALGNGGCQHHCVQ

LTITRHRCQCRPGFQLQEDGRHCVRRSPCANRNGSCMHRCQVVRGLARCECHVGYQLAADGKACEDVDECAAGLA

QCAHGCLNTQGSFKCVCHAGYELGADGRQCYRIEMEIVNSCEANNGGCSHGCSHTSAGPLCTCPRGYELDTDQRT

CIRCRRLCRQPVLQQVCTNNPGGYECGCYAGYRLSADGCGCEDNDECASSRGGCEHHCTNLAGSFQCSCEAGYRL

HEDRRGCSALEEPMVDLDGELPFVRPLPHIAVLQDELPQLFQDDDVGADEEEAELRGEHTLTEKFVCLDDSFGHD

CSLTCDDCRNGGTCLLGLDGCDCPEGWTGLICNESCPPDTFGKNCSFSCSCQNGGTCDSVTGACRCPPGVSGTNC

EDGCPKGYYGKHCRKKCNCANRGRCHRLYGACLCDPGLYGRFCHLACPPWAFGPGCSEECQCVQPHTQSCDKRDG

SCSCKAGFRGERCQAECEPGYFGPGCWQACTCPVGVACDSVSGECGKRCPAGFQGEDCGQECPVGTFGVNCSSSC

SCGGAPCHGCTGQCRCPPGRTGEDCEAGECEGLWGLGCQEICPACHNAARCDPETGACLCLPGFVGSRCQDCEAG

WYGPSCOTMCSCANDGHCHQDTGHCSCAPGWTGFSCQRACDTGHWGPDCSHPCNCSAGHGSCDAISGLCLCEAGY

VGPRCEQSECPQGHFGPGCEQRCQCQHGAACDHVSGACTCPAGWRGTFCEHACPAGFFGLDCRSACNCTAGAACD

AVNGSCLCPAGRRGPRCAESACPAHTYGHNCSQACACFNGASCDPVHGQCHCAPGWMGPSCLQACPAGLYGDNCR

HSCLCQNGGTCDPVSGHCACPEGWAGLACEVECLPRDVRAGCRHSGGCLNGGLCDPHTGRCLCPAGWTGDKCQSP

AACAKGTFGPHCEGRCACRWGGPCHLATGACLCPPGWRGPHLSAACLRGWFGEACAQRCSCPPGAACHHVTGACR

CPPGFTGSGCEQACPPGSFGEDCAQMCQCPGENPACHPATGTCSCAAGYHGPSCQQRCPPGRYGPGCEQLCGCLN

GGSCDAATGACRCPTGFLGTDCNLTCPQGRFGPNCTHVCGCGQGAACDPVTGTCLCPPGRAGVRCERGCPQNRFG

VGCEHTCSCRNGGLCHASNGSCSCGLGWTGRHCELACPPGRYGAACHLECSCHNNSTCEPATGTCRCGPGFYGQA

CEHPCPPGFHGAGCQGLCWCQHGAPCDPISGRCLCPAGFHGHFCERGCEPGSFGEGCHQRCDCDGGAPCDPVTGL

CLCPPGRSGATCNLDCRRGQFGPSCTLHCDCGGGADCDPVSGQCHCVDGYMGPTCREAGTLPASSRPTSRSGGPA

RH

The SignalP, Psort and/or Hydropathy results indicate that NOV15f has a signal peptide and is likely to be localized extracellularly with a certainty of 0.8200. Alternatively, a NOV15f polypeptide is located to the lysosome (lumen) with a certainty of 0.1900, the endoplasmic reticulum (membrane) with a certainty of 0.1000, or the endoplasmic reticulum (lumen) with a certainty of 0.1000. The SignalP NOV15 Clones Unless specifically addressed as NOV15a, NOV15b, NOV15c, NOV15d, NOV15e, or NOV15 f any reference to NOV15 is assumed to encompass all variants.

A search against the Patp database, a proprietary database that contains sequences published in patents and patent publication, yielded several homologous proteins shown in Table 15M.

TABLE 15M

PatP Results for NOV15

| Sequences Producing High-Scoring Segment Pairs: | High Score | Smallest Sum Prob P (N) |
|---|---|---|
| patp: AAY72091 Human serine protease #2 encoded by clone HMGBM65 | 2570 | 5.8e-267 |
| patp: AAB66267 Human TANGO 272 | 1416 | 1.1e-144 |
| patp: AAY72715 HFICU08 clone human attractin-like protein | 1396 | 1.5e-142 |
| patp: AAB66269 Rat TANGO 272 | 1200 | 8.6e-122 |
| patp: AAG75479 Human colon cancer antigen protein | 945 | 3.4e-94 |

In a BLAST search of public sequence databases, it was found, for example, that the NOV15a nucleic acid sequence of this invention has 2717 of 3360 bases (80%) identical to a gb:GENBANK-ID:AB011532|acc:AB011532.1 mRNA from *Rattus norvegicus* mRNA for MEGF6, complete cds. Further, the full amino acid sequence of the disclosed NOV15a protein of the invention has 1060 of 1364 amino acid residues (77%) identical to, and 1147 of 1364 amino acid residues (84%) similar to, the 1574 amino acid residue ptnr:SPTREMNML-ACC:O88281 protein from Rat (MEGF6).

In a similar BLAST search of public sequence databases, it was found, for example, that the NOV15b nucleic acid sequence of this invention has 2624 of 3343 bases (78%) identical to a gb:GENBANK-ID:AB011532|acc:AB011532.1 mRNA from *Rattus norvegicus* mRNA for MEGF6, complete cds. Further, the full amino acid sequence of the disclosed NOV15b protein of the invention has 1045 of 1363 amino acid residues (76%) identical to, and 1131 of 1363 amino acid residues (82%) similar to, the 1574 amino acid residue ptnr:SPTREMBL-ACC:O88281 protein from Rat (MEGF6).

In a similar BLAST search of public sequence databases, it was found, for example, that the NOV15c nucleic acid sequence of this invention has 3219 of 4514 bases (71%) identical to a gb:GENBANK-ID:AB011532|acc:AB011532.1 mRNA from *Rattus norvegicus* mRNA for MEGF6, complete cds. Further, the full amino acid sequence of the disclosed NOV15c protein of the invention has 966 of 1426 amino acid residues (67%) identical to, and 1062 of 1426 amino acid residues (74%) similar to, the 1574 amino acid residue ptnr:SPTREMBL-ACC:O88281 protein from Rat (MEGF6).

In a similar BLAST search of public sequence databases, it was found, for example, that the NOV15d nucleic acid sequence of this invention has 650 of 687 bases (94%) identical to a gb:GENBANK-ID:AB011539|acc:AB011539.1 mRNA from *Homo sapiens* mRNA for MEGF6, partial cds. Further, the full amino acid sequence of the disclosed NOV15d protein of the invention has 106 of 141 amino acid residues (75%) identical to, and 108 of 141 amino acid residues (76%) similar to, the 153 amino acid residue ptnr:SPTREMBL-ACC:O75095 protein from Human (MEGF6).

In a further BLAST search of public sequence databases, it was found, for example, that the NOV15e nucleic acid sequence of this invention has 1072 of 1072 bases (100%) identical to a gb:GENBANK-ID:AB011539|acc:AB011539.1 mRNA from *Homo sapiens* mRNA for MEGF6, partial cds. Further, the full amino acid sequence of the disclosed NOV15e protein of the invention has 1059 of 1363 amino acid residues (77%) identical to, and 1147 of 1363 amino acid residues (84%) similar to, the 1574 amino acid residue ptnr:SPTREMBL-ACC:O88281 protein from Rat (MEGF6).

In yet a further BLAST search of public sequence databases, it was found, for example, that the NOV15f nucleic acid sequence of this invention has 2755 of 3390 bases (81%) identical to a gb:GENBANK-ID:AB011532|acc:AB011532.1 mRNA from *Rattus norvegicus* mRNA for MEGF6, complete cds. Further, the full amino acid sequence of the disclosed NOV15f protein of the invention has 1222 of 1562 amino acid residues (78%) identical to, and 1322 of 1562 amino acid residues (84%) similar to, the 1574 amino acid residue ptnr:SPTREMBL-ACC:O88281 protein from Rat (MEGF6).

Additional BLAST results are shown in Table 15N.

TABLE 15N

NOV15 BLASTP Results

| Gene Index/ Identifier | Protein/Organism | Length of aa | Identity (%) | Positives (%) | Expect Value |
|---|---|---|---|---|---|
| O88281 | MEGF6 - *Rattus norvegicus* (Rat) | 1574 | 1060/1364 (77%) | 1147/1364 (84%) | 0.0 |
| Q9TVQ2 | Y64G10A.7 PROTEIN - *Caenorhabditis elegans* | 1664 | 519/1245 (41%) | 673/1245 (54%) | 2.3e-293 |
| T27283 | hypothetical protein YG4G10A.f - *Caenorhabditis elegans* | 1620 | 461/1272 (36%) | 609/1272 (47%) | 8.5e-225 |
| Q9GKG6 | MEGF11 PROTEIN (KIAA1781) - *Homo sapiens* (Human) | 969 | 311/730 (42%) | 393/730 (53%) | 1.6e-182 |
| Q96KG7 | MEGF10 PROTEIN (KIAA1780) - *Homo sapiens* (Human) | 1140 | 302/734 (41%) | 388/734 (52%) | 4.6e-178 |

A multiple sequence alignment is given in Table 15O, with the NOV15 proteins of the invention being shown in lines 1 through 6 in a ClustalW analysis comparing NOV15 with related protein sequences of Table 15N.

Table 15O. ClustalW Analysis of NOV15

1. SEQ ID NO.: 44   NOV15a
2. SEQ ID NO.: 46   NOV15b
3. SEQ ID NO.: 48   NOV15c
4. SEQ ID NO.: 50   NOV15d
5. SEQ ID NO.: 52   NOV15e
6. SEQ ID NO.: 54   NOV15f
7. SEQ ID NO.: 211  O88281
8. SEQ ID NO.: 212  Q9TVQ2
9. SEQ ID NO.: 213  T27283
10. SEQ ID NO.: 214 Q96KG6
11. SEQ ID NO.: 215 Q96KG7

```
                 10        20        30        40        50        60
          ....|....|....|....|....|....|....|....|....|....|....|....|
NOV15a    MPMGHSDRWSWRLLRLALPLPVWLPAGGGRGADS----PCLCSRPHVCAEQELTLVGRRQ  56
NOV15b    MPMGHSDRWSWRLLRLALPLPVWLPAGGGRGADS----PCLCSRPHVCAEQELTLVGRRQ  56
NOV15c    MPMGHSDRWSWRLLRLALPLPVWLPAGGGRGADS----PCLCSRPHVCAEQELTLVGRRQ  56
NOV15d    ------------------------------------------------------------   1
NOV15e    MPMGHSDRWSWRLLRLALPLPVWLPAGGGRGADS----PCLCSRPHVCAEQELTLVGRRQ  56
NOV15f    MSFLEEARAAGRAVVLALVLLLLPAVPVGASVPPRPLLPLQPGMPHVCAEQELTLVGRRQ  60
O88281    MPVRAEARAAWRVVALALLLLPAMPAASPPLTPR----PLQPSMPHVCAEQKLTLVGHRQ  56
Q9TVQ2    MDMRSCTHHLLPVSKLMVLCKFFCVDILNFTS--------IFFRELGEIERLDFLPFNF   51
T27283    MDMRSCTHHLLPVSKLMVLCKFFCVDILNFTS--------IFFRELGEIERLDFLPFNF   51
Q96KG6    ------------------------------------------------------------   1
Q96KG7    ------------------------------------------------------------   1

70        80        90       100       110       120
          ....|....|....|....|....|....|....|....|....|....|....|....|
NOV15a    PCVQALSHTVPVWK-AGCGWQAWCVGHERRTVYYMGYRQVYTTEARTVLRCCRGWMQQPD 115
NOV15b    PCVQALSHTVPVWK-AGCGWQAWCVGHERRTVYYMGYRQVYTTEARTVLRCCRGWTQQPD 115
NOV15c    PCVQALSHTVPVWK-AGCGWQAWCVGHERRTVYYMGYRQVYTTEARTVLRCCRGWTQQPD 115
NOV15d    ------------------------------------------------------------   1
NOV15e    PCVQALSHTVPVWK-AGCGWQAWCVGHERRTVYYMGYRQVYTTEARTVLRCCRGWMQQPD 115
NOV15f    PCVQALSHTVPVWK-AGCGWQAWCVGHERRTVYYMGYRQVYTTEARTVLRCCRGWMQQPD 119
O88281    PCVQAFSRIVPVWRRTGCAQQAWCIGQERRTVYYMSYRQVYATEARTVFRCCPGWSQKPG 116
Q9TVQ2    HARKYLRFARFSRR--GCSKCCLLRVQANCSADLCHNGGTCVPSEHNDNEQVCECPVGFT 109
T27283    HARKYLRFARFSRR--GCSKCCLLRVQANCSADLCHNGGTCVPSEHNDNEQVCECPVGFT 109
```

229

```
Q96KG6   ---------------------------------------------------------     1
Q96KG7   ------------------MVISLNSCLSFICLLLCHWIGTASPLNLEDPNVCSHWESYSV  42
```

230

```
              130       140       150       160       170       180
         ....|....|....|....|....|....|....|....|....|....|....|....|
NOV15a   EEGCLSDVGECANANGGCAGRCRDTVGGFYCRWPPPSHQLQGDGETCQDVDECRTHNGGC  175
NOV15b   EEGCLS--AECSASLCFHGGRCVPGS-AQPCHCPP-G--FQGP-RCQYDVDECRTHNGGC  168
NOV15c   EEGCLS--AECSASLCFHGGRCVPGS-AQPCHCPP-G--FQGP-RCQYDVDECRTHNGGC  168
NOV15d   ------------------------------------------------------------    1
NOV15e   EEGCLSDVGECANANGGCAGRCRDTVGGFYCRWPPPSHQLQGDGETCQDVDECRTHNGGC  175
NOV15f   EEGCLSDVGECANANGGCAGRCRDTVGGFYCRWPPPSHQLQGDGETCQDVDECRTHNGGC  179
O88281   QEGCLSDVDECASANGGCEGPCCNTVGGFYCRCPP-GYQLQGDGKTCQDVDECRAHNGGC  175
Q9TVQ2   GAKCQYDANECMANNGGCEHECVNTIGTYYCRCWP-GFELSGDGNTCSDIDECAVSNGGC  168
T27283   GAKCQYDANECMANNGGCEHECVNTIGTYYCRCWP-GFELSGDGNTCSDIDECAVSNGGC  168
Q96KG6   ------------------------------------------------------------    1
Q96KG7   TVQESYP---------------------------HPFDQIYYTSCTDILN           65
```

```
              190       200       210       220       230       240
         ....|....|....|....|....|....|....|....|....|....|....|....|
NOV15a   QHRCVNTPGSYLCECKPGFRLHTDSRTC-------------AINSCALGNGGCQHCVQL  222
NOV15b   QHRCVNTPGSYLCECKPGFRLHTDSRTCL------------AINSCALGNGGCQHCVQL  216
NOV15c   QHRCVNTPGSYLCECKPGFRLHTDSRTCL------------AINSCALGNGGCQHCVQL  216
NOV15d   ------------------------------------------------------------    1
NOV15e   QHRCVNTPGSYLCECKPGFRLHTDSRTC-------------AINSCALGNGGCQHCVQL  222
NOV15f   QHRCVNTPGSYLCECKPGFRLHTDSRTC-------------AINSCALGNGGCQHCVQL  226
O88281   QHRCVNTPGSYLCECKPGFRLHTDGRTCL------------AISSCTLGNGGCQHQCVQL  223
Q9TVQ2   SDRCVNSPGGFRCDCPSDLYLHADGRTCGSGFHFENLILIKKVTSCSTDNGGCEHECEND  228
T27283   SDRCVNSPGGFRCDCPSDLYLHADGRTCG------------KVTSCSTDNGGCEHECEND  216
Q96KG6   -----MHTPSIR-SITHDAQTSSTGSS--------------------------------   21
Q96KG7   WFKCTRHRVSYRTAYRHGEKTMYRRKSQ-------------------------------   93
```

```
              250       260       270       280       290       300
         ....|....|....|....|....|....|....|....|....|....|....|....|
NOV15a   TIT-RHRCQCRPGFQLQEDGRHCVRRSPCANRNGSCMHRCQVVRGLARCECHVGYQLAAD  281
NOV15b   TIT-RHRCQCRPGFQLQEDGRHCVRRSPCANRNGSCMHRCQVVRGLARCECHVGYQLAAD  275
NOV15c   TIT-RHRCQCRPGFQLQEDGRHCVRRSPCANRNGSCMHRCQVVRGLARCECHVGYQLAAD  275
NOV15d   ------------------------------------------------------------    1
NOV15e   TIT-RHRCQCRPGFQLQEDGRHCVRRSPCANRNGSCMHRCQVVRGLARCECHVGYQLAAD  281
NOV15f   TIT-RHRCQCRPGFQLQEDGRHCVRRSPCANRNGSCMHRCQVVRGLARCECHVGYQLAAD  285
O88281   IVT-QHRCQCRPQYQLQEDGRRCVRRSPCAEGNGGCMHICQELRGLAHCGCHPGYQLAAD  282
Q9TVQ2   SNGEFYRCRCRVGFKLSENKRSCQPVDPCFDNKGGCQHHCTNNHGRAQCQCYPGFHLSYD  288
T27283   SNGEFYRCRCRVGFKLSENKRSCQPVDPCFDNKGGCQHHCTNNHGRAQCQCYPGFHLSYD  276
Q96KG6   ---------APG--------TALCTEECVHGRCVSPDTCHCEPGWGGPDCSSGCDSDHW   63
Q96KG7   --------CCPGFYESGEMCVPHCADKCVHGRCIAPNTCQCEPGWGGTNCSSACDGDHW  144
```

```
              310       320       330       340       350       360
         ....|....|....|....|....|....|....|....|....|....|....|....|
NOV15a   GKACEDVDECAAGLAQCAHGCLNTQGSFKCVCHAGYELGADGRQCYRIEMETVNSCEANN  341
NOV15b   GKACEDVDECAAGLAQCAHGCLNTQGSFKCVCHAGYELGADGRQCYRIEMETVNSCEANN  335
NOV15c   GKACEDVDECAAGLAQCAHGCLNTQGSFKCVCHAGYELGADGRQCYRIEMETVNSCEANN  335
NOV15d   ------------------------------------------------------------    1
NOV15e   GKACEDVDECAAGLAQCAHGCLNTQGSFKCVCHAGYELGADGRQCYRIEMETVNSCEANN  341
NOV15f   GKACEDVDECAAGLAQCAHGCLNTQGSFKCVCHAGYELGADGRQCYRIEMETVNSCEANN  345
O88281   RKTCEDVDECALGLAQCAHGCLNTQGSFKCVCHAGYELGADGRQCYRIEMETVNSCEAGN  342
Q9TVQ2   RRSCVDIDECAK-NNGCEHFCENVKGTYRCKCREGYQLGRDGRTC----EEMLGGCQVGN  343
T27283   RRSCVDIDECAK-NNGCEHFCENVKGTYRCKCREGYQLGRDGRTC----EEMLGGCQVGN  331
Q96KG6   GPHCSNRCQCQN------GALCNPITGACVCAAGERG---WR-----------------   96
```

```
Q96KG7   GPHCTSRCQCKN------GALCNPITGACHCAAGFRG---WR------------------ 177

370       380       390       400       410       420
                ....|....|....|....|....|....|....|....|....|....|....|....|
NOV15a   GGCSHGCSHTSAG-PLCTCPRGYELDTDQRTCIR-------------------------- 374
NOV15b   GGCSHGCSHTSAG-PLCTCPRGYELDTDQRTCIR-------------------------- 368
NOV15c   GGCSHGCSHTSAG-PLCTCPRGYELDTDQRTCIR-------------------------- 368
NOV15d   ------------------------------------------------------------ 1
NOV15e   GGCSHGCSHTSAG-PLCTCPRGYELDTDQRTCIR-------------------------- 374
NOV15f   GGCSHGCSHTSAG-PLCTCPRGYELDTDQRTCIR-------------------------- 378
O88281   GGCSHGCSHTSTG-PLCTCPRGYELDEDQKTCID-------------------------- 375
Q9TVQ2   GGCQHDCYDQPDGGHVCKCRNGYILANDQKLCHD-------------------------- 377
T27283   GGCQHDCYDQPDGGHVCKCRNGYILANDQKLCHDNISTVIHARAPRLWDSYETVTCVTPT 391
Q96KG6   --CEELCAPGTHG----------------------------------------------- 107
Q96KG7   --CEDRCEQGTYG----------------------------------------------- 188

430       440       450       460       470       480
                ....|....|....|....|....|....|....|....|....|....|....|....|
NOV15a   ---------------------------------CRRLCRQPVLQQVCTNNPGGYECGC 399
NOV15b   ---------------------------------CRRLCRQPVLQQVCTNNPGGYECGC 393
NOV15c   ---------------------------------CRRLCRQPVLQQVCTNNPGGYECGC 393
NOV15d   ------------------------------------------------------------ 1
NOV15e   ---------------------------------CRRLCRQPVLQQVCTNNPGGYECGC 399
NOV15f   ---------------------------------CRRLCRQPVLQQVCTNNPGGYECGC 403
O88281   ---------------------------------IDDCANSPCCQQACANTPGGYECSC 400
Q9TVQ2   ---------------------------------INECHENNGDCSQICVNLAGSVECQC 403
T27283   DLTCHKLCMHLDSGHVQCFCDDGYELIDSKFCQDINECHENNGDCSQICVNLAGSVECQC 451
Q96KG6   ---------------------------------KG-CQLPCQCRHGASCDPRAGECLC 131
Q96KG7   ---------------------------------ND-CHQRCQCQNGATCDHVTGECRC 212

490       500       510       520       530       540
                ....|....|....|....|....|....|....|....|....|....|....|....|
NOV15a   YAGYRLSADGCGCEDVDECASSRGGCEHHCTNLAGSFQCSCEAGYRLHEDRRGCSALEEP 459
NOV15b   YAGYRLSADGCGCEDVDECASSRGGCEHHCTNLAGSFQCSCEAGYRLHEDRRGCSALEEP 453
NOV15c   YAGYRLSADGCGCEDVDECASSRGGCEHHCTNLAGSFQCSCEAGYRLHEDRRGCSALEEP 453
NOV15d   ------------------------------------------------------------ 1
NOV15e   YAGYRLSADGCGCEDVDECASSRGGCEHHCTNLAGSFQCSCEAGYRLHEDRRGCSALEEP 459
NOV15f   YAGYRLSADGCGCEDVDECASSRGGCEHHCTNLAGSFQCSCEAGYRLHEDRRGCSALEEP 463
O88281   FAGYRLNTDGCGCEDVDECASGHGGCEHHCSNLAGSPQCFCEAGYRLDEDRRGCTSLEES 460
Q9TVQ2   KPGFRLMKDRKTCEDISECSSNNGGCEQICSNQEGGYMCSCEPGFELSEDGHSCHDMNEC 463
T27283   KPGFRLMKDRKTCEDISECSSNNGGCEQICSNQEGGYMCSCEPGFELSEDGHSCHDMNEC 511
Q96KG6   APGY----TGVYCEELCPPGSHGAHCELRCP----------------------------- 158
Q96KG7   PPGY----TGAFCEDLCPPGKHGPQCEQRCP----------------------------- 239

550       560       570       580       590       600
                ....|....|....|....|....|....|....|....|....|....|....|....|
NOV15a   MVDLDGELPFVRP--------LPHIAVLQDELPQLFQDDD----VGADEEAELRGEHT 506
NOV15b   MVDLDGELPFVRP--------LPHIAVLQDELPQLFQDDD----VGADEEAELRGEHT 500
NOV15c   MVDLDGELPFVRP--------LPHIAVLQDELPQLFQDDD----VGADEEAELRGEHT 500
NOV15d   ------------------------------------------------------------ 1
NOV15e   MVDLDGELPFVRP--------LPHIAVLQDELPQLFQDDD----VGADEEAELRGEHT 506
NOV15f   MVDLDGELPFVRP--------LPHIAVLQDELPQLFQDDD----VGADEEAELRGEHT 510
O88281   VVDLDGRLPFVRP--------LPHIAVLRDELPRLFQDDYG---AEEEAAAAELRGEHT 508
Q9TVQ2   LINNGGCAQLCKNRKGSRRCQCFAGYILAHDEKSCVAASDSADIFSNDIEDYSKVPGLDS 523
T27283   LINNGGCAQLCKNRKGSRRCQCFAGYILAHDEKSCVAASDSADIFSNDIEDYSKVPGLDS 571
Q96KG6   ------------------------------------------------------------ 158
Q96KG7   ------------------------------------------------------------ 239
```

233 234

```
                   610       620       630       640       650       660
                ....|....|....|....|....|....|....|....|....|....|....|....|
NOV15a   LTEKFVCLDDS---------------------------------------F 518
NOV15b   LTEKFVCLDDS---------------------------------------F 512
NOV15c   LTEKFVCLDDS---------------------------------------F 512
NOV15d   -------------------------------------------------- 1
NOV15e   LTEKFVCLDDS---------------------------------------F 518
NOV15f   LTEKFVCLDDS---------------------------------------F 522
O88281   LTEKFVCLDHS---------------------------------------F 520
Q9TVQ2   TDEVISSIESYPADESPRPLVFGRRRHVKACVNFQGTLSLELFSSEVRTDPSEKCPNGFF 583
T27283   TDEVISSIESYPADESPRPLVFGRRRHVKACVNFQGTLSLELFSSEVRTDPSEKCPNGFF 631
Q96KG6   -------------------------------------------------- 158
Q96KG7   -------------------------------------------------- 239

670       680       690       700       710       720
                ....|....|....|....|....|....|....|....|....|....|....|....|
NOV15a   GHDCSLTCDDCRNGGTCLLG----LDGCDCPEGWTGLICNESCPPDTFGKNCSFSCSCQN 574
NOV15b   GHDCSLTCDDCRNGGTCLLG----LDGCDCPEGWTGLICNESCPPDTFGKNCSFSCSCQN 568
NOV15c   GHDCSLTCDDCRNGGTCLLG----LDGCDCPEGWTGLICNESCPPDTFGKNCSFSCSCQN 568
NOV15d   ------------------------------------------------------------ 1
NOV15e   GHDCSLTCDDCRNGGTCLLG----LDGCDCPEGWTGLICNESCPPDTFGKNCSFSCSCQN 574
NOV15f   GHDCSLTCDDCRNGGTCLLG----LDGCDCPEGWTGLICNESCPPDTFGKNCSFSCSCQN 578
O88281   GHDCSLTCDDCRNGGTCFPG----QDGCDCPEGWTGILCNETCPPDTFGKNCSSPCTCQN 576
Q9TVQ2   GSTCQLSCSDCQNGGKCSMRGSGLLSKCDCPSGYTEKCEQICRNGYWGVDCAHKCSCK-  642
T27283   GSTCQLSCSDCQNGGKCSMRGSGLLSKCDCPSGYTEKCEQICRNGYWGVDCAHKCSCK-  690
Q96KG6   -------CQNGGTCHHITG----ECACPPGWTGAVCAQPCPEGTFGQNCSQDCPCHH  204
Q96KG7   -------CQNGGVCHHVTG----ECSCPSGWMGTVCGQPCPEGRFGKNCSQECQCHN  285

730       740       750       760       770       780
                ....|....|....|....|....|....|....|....|....|....|....|....|
NOV15a   GGTCDSVTGACRCPPGVSGTNCEDG-CPKGYYGKHCRKKCNCAN-RGRCHRLYGACLCDP 632
NOV15b   GGTCDSVTGACRCPPGVSGTNCEDG-CPKGYYGKHCRKKCNCAN-RGRCHRLYGACLCDP 626
NOV15c   GGTCDSVTGACRCPPGVSGTNCEDG-CPKGYYGKHCRKKCNCAN-RGRCHRLYGACLCDP 626
NOV15d   ------------------------------------------------------------ 1
NOV15e   GGTCDSVTGACRCPPGVSGTNCEDG-CPKGYYGKHCRKKCNCAN-RGRCHRLYGACLCDP 632
NOV15f   GGTCDSVTGACRCPPGVSGTNCEDG-CPKGYYGKHCRKKCNCAN-RGRCHRLYGACLCDP 636
O88281   GGTCDPVLGACRCPPGVSGAHCEDG-CPKGFYGKHCRKKCHCAN-RGRCHRLYGACLCDP 634
Q9TVQ2   --LCDPSTGSCRCED---PEKCSDGPCPDGFYGSQCNLKCRMDCPNGRCDPVEGYCTCPD 697
T27283   --LCDPSTGSCRCED---PEKCSDGPCPDGFYGSQCNLKCRMDCPNGRCDPVEGYCTCPD 745
Q96KG6   GGQCDHVTGQCHCTAGYMGDRCQEE-CPFGSFGFQCSQRCDCHN-GGQCSPTTGACECEP 262
Q96KG7   GGTCDAATGQCHCSPGYTGERCQDE-CPVGTYGVLCAETCQCVN-GGKCYHVSGACLCEA 343

790       800       810       820       830       840
                ....|....|....|....|....|....|....|....|....|....|....|....|
NOV15a   GLYG-RFCHLACPPWAFGPGCSEECQCVQPHTQSCDKRDGSCSCKAGFRGERCQAECEPG 691
NOV15b   GLYG-RFCHLACPPWAFGPGCSEECQCVQPHTQSCDKRDGSCSCKAGFRGERCQAECEPG 685
NOV15c   GLYG-RFCHLACPPWAFGPGCSEECQCVQPHTQSCDKRDGSCSCKAGFRGERCQAECELG 685
NOV15d   ------------------------------------------------------------ 1
NOV15e   GLYG-RFCHLACPPWAFGPGCSEECQCVQPHTQSCDKRDGSCSCKAGFRGERCQAECEPG 691
NOV15f   GLYG-RFCHLACPPWAFGPGCSEECQCVQPHTQSCDKRDGSCSCKAGFRGERCQAECEPG 695
O88281   GLYG-RFCHLACPPWAFGPGCSEDCLCEQSHTRSCNPKDGSCSCKAGFQGERCQAECESG 693
Q9TVQ2   GLYG-QSCEKPCPHFTFGKNCRFPCKCARENSEGCDEITGKCRCKPGYYGHHCKRMCSPG 756
T27283   GLYG-QSCEKPCPHFTFGKNCRFPCKCARENSEGCDEITGKCRCKPGYYGHHCKRMCSPG 804
Q96KG6   GYKGPRCQERLCPEGLHGPGCILPCPCDADNTISCHPVTGACTCQPGWSGHHCNESCPVG 322
Q96KG7   GFAGERCEARLCPEGLYGIKCDKRCPCHLENTHSCHPMSGECACKPGWSGLYCNETCSPG 403
```

235 236

```
              850        860        870        880        890        900
             ....|....|....|....|....|....|....|....|....|....|....|....|
    NOV15a   YFGPGCWQACTCPVGVACDSVSGECGKRCPAGFQGEDCGQECPVGTFGVNCSSSCSCGGA  751
    NOV15b   YFGPGCWQACTCPVGVACDSVSGECGKRCPAGFQGEDCGQECPVGTFGVNCSSSCSCGGA  745
    NOV15c   YFGPGCWQACTCPVGVACDSVSGECGKRCPAGFQGEDCGQECPVGTFGVNCSSSCSCGGA  745
    NOV15d   -MAP-----ASAPLAAGAPAVP--RPALPA---------CTATTVGIPAS--------   33
    NOV15e   YFGPGCWQACTCPVGVACDSVSGECGKRCPAGFQGEDCGQECPVGTFGVNCSSSCSCGGA  751
    NOV15f   YFGPGCWQACTCPVGVACDSVSGECGKRCPAGFQGEDCGQECPVGTFGVNCSSSCSCGGA  755
    O88281   FFGPGCRHRCTCQPGVACDPVSGECRTCPPGYQGEDCGQECPVGTFGVNCSGSCSCVGA  753
    Q9TVQ2   LFGAGCAMKCSCPAGVIRCDPVTGDCTKKCPAGYQGNLCDQPCPAGYFGYLCEQKCSCADV 816
    T27283   LFGAGCAMKCSCPAGVIRCDPVTGDCTKKCPAGYQGNLCDQPCPAGYFGYLCEQKCSCADV 864
    Q96KG6   YYGDGCQLPCTCQNGADCHSLTG--GCTCAPGFMGEVCAVSCAAGTYGPNCSSICSCNNG  380
    Q96KG7   FYGEACQQICSCQNGADCDSVTG--KCTCAPGFKGIDCSTPCPLGTYGINCSSRCGCKND  461

910        920        930        940        950        960
             ....|....|....|....|....|....|....|....|....|....|....|....|
    NOV15a   P------CHGVTGQCRCPPGRTGEDCEAG-------------------ECEGLWGLGCQ  785
    NOV15b   P------CHGVTGQCRCPPGRTGEDCEAG-------------------ECEGLWGLGCQ  779
    NOV15c   P------CHGVTGQCRCPPGRTGEDCEAD-------------------CPEGRWGLGCQ  779
    NOV15d   ----------------ART----------------------EG-------             38
    NOV15e   P------CHGVTGQCRCPPGRTGEDCEAG-------------------ECEGLWGLGCQ  785
    NOV15f   P------CHGVTGQCRCPPGRTGEDCEAG-------------------ECEGLWGLGCQ  789
    O88281   P------CHRVTGECLCPPGRTGEDCGAD-------------------CPEGRWGLGCQ  787
    Q9TVQ2   ASPHKSKVCHHVTGTCTCLPGRTGPLCQQS-------------------CAPNTYGPNCA  857
    T27283   ASPHKSKVCHHVTGTCTCLPGRTGPLCQQCLIFVETIEFDIAFSINVIACAPNTYGPNCA  924
    Q96KG6   G------TCSPVDGSCTCKEGWQGLDCTLP-------------------CPSGTWGLNCN  415
    Q96KG7   A------VCSPVDGSCTCKAGWHGVDCSIR-------------------CPSGTWGFGCN  496

970        980        990       1000       1010       1020
             ....|....|....|....|....|....|....|....|....|....|....|....|
    NOV15a   EICPACHNAARCDPETGACLCLPGFVGSRCQD-CEAGWYGPSCQTMCSCANDGHCHQDTG  844
    NOV15b   EICPACHNAARCDPETGACLCLPGFVGSRCQD-CEAGWYGPSCQTMCSCANDGHCHQDTG  838
    NOV15c   EICPACQHAARCDPETGACLCLPGFVGSRCQDVCPAGWYGPSCQTRCSCANDGHCHPATG  839
    NOV15d   ----------PVT----------------------------------------------   41
    NOV15e   EICPACHNAARCDPETGACLCLPGFVGSRCQD-CEAGWYGPSCQTMCSCANDGHCHQDTG  844
    NOV15f   EICPACHNAARCDPETGACLCLPGFVGSRCQD-CEAGWYGPSCQTMCSCANDGHCHQDTG  848
    O88281   EICPACENGASCNPETGTCLCLPGFVGSRCQDTCSAGWYGTGCQIRCACANDGHCDPTTG  847
    Q9TVQ2   HTCS-CVNGAKCDESDGSCHCTPGFYGATCSEVCPTGRFGIDCMQLCKCQNGAICDTSNG  916
    T27283   HTCS-CVNGAKCDESDGSCHCTPGFYGATCSEVCPTGRFGIDCMQLCKCQNGAICDTSNG  983
    Q96KG6   ESCT-CANGAACSPIDGSCSCTPGWLGDTCELPCPDGTFGLNCSEHDCSHADGCDPVTG   474
    Q96KG7   LTCQ-CLNGGACNTLDGTCTCAPGWRGEKCELPCQDGTYGLNCAERDCSHADGCHPTTG   555

1030       1040       1050       1060       1070       1080
             ....|....|....|....|....|....|....|....|....|....|....|....|
    NOV15a   HCSCAPGWTGFSCQRACDTGHWGPDCSHPCNCSAGHGSCDAISGLCLCEAGYVGPRCEQS  904
    NOV15b   HCSCAPGWTGFSCQRACDTGHWGPDCSHPCNCSAGHGSCDAISGLCLCEAGYVGPRCEQS  898
    NOV15c   HCSCAPGWTGFSCQRACDTGHWGPDCSHPCNCSAGHGSCDAISGLCLCEAGYVGPRCEQQ  899
    NOV15d   ------------------------------------LSQA------CEHP            49
    NOV15e   HCSCAPGWTGFSCQRACDTGHWGPDCSHPCNCSAGHGSCDAISGLCLCEAGYVGPRCEQS  904
    NOV15f   HCSCAPGWTGFSCQRACDTGHWGPDCSHPCNCSAGHGSCDAISGLCLCEAGYVGPRCEQS  908
    O88281   RCSCAPGWTGLSCQRACDSGHWGPDCIHPCNCSAGHGNCDAVSGLCLCEAGYEGPRCEQS  907
    Q9TVQ2   SCECAPGWSGKKCDKACAPGTFGKDCSKKCDCADG-MHCDPSDGECICPPGKKCHKCDET  975
    T27283   SCECAPGWSGKKCDKACAPGTFGKDCSKKCDCADG-MHCDPSDGECICPPGKKCHKCDET 1042
    Q96KG6   HCCLAGWTGIRCDSTCPPGRWGPNCSVSCSCENG-GSCSPEDGSCECAPGTRGPLCQRI   533
    Q96KG7   HCRCLPGWSGVHCDSVCAEGRWGPNCSLPCYKNG-ASCSPDDGLCECAPGFRGTTCQRI   614

1090       1100       1110       1120       1130       1140
```

237 238

```
NOV15a   ECPQGHFGPGCEQRC--QCQHGAACDHVSGACTCPAGWRGTFCEHACPAGFFGLDCRSAC  962
NOV15b   ECPQGHFGPGCEQRC--QCQHGAACDHVSGACTCPAGWRGTFCEHACPAGFFGLDCRSAC  956
NOV15c   -CPQGHFGPGCEQLC--QCQHGAACDHVSGACTCPAGWRGTFCEHACPAGFFGLDCRSAC  956
NOV15d   -CPPGFHGAGRQGLC--WCQHGAPCDPISGRCLCPAGFHGHFCERDCRRGQFGPSCTLHC  106
NOV15e   ECPQGHFGPGCEQRC--QCQHGAACDHVSGACTCPAGWRGTFCEHACPAGFFGLDCRSAC  962
NOV15f   ECPQGHFGPGCEQRC--QCQHGAACDHVSGACTCPAGWRGTFCEHACPAGFFGLDCRSAC  966
O88281   -CRQGYYGPSCEQKC--RCEHGAACDHVSGACTCPAGWRGSFCEHACPAGEFGLDCDSAC  964
Q9TVQ2   -CDSGLFGAGCKGIC--SCQNGATCDSVTGSCECRPGWRGKKCDRPCPDGRFGEGCNAIC 1032
T27283   -CDSGLFGAGCKGIC--SCQNGATCDSVTGSCECRPGWRGKKCDRPCPDGRFGEGCNAIC 1099
Q96KG6   -CPPGFYGHGCAQPCPLCVHSSRPCHHISGICECLPGFSGALCNQVCAGGYFGQDCAQLC  592
Q96KG7   -CSPGFYGHRCSQTCPQCVHSSGPCHHIGLCDCLPGHTGALCNEVCPSGRFGKNCAGIC  673
```

```
              1150      1160      1170      1180      1190      1200
NOV15a   NCTAG----------AACDAVNGSCLCPAGRRGPRCAESACPAHTYGHNCSQACACFNGA 1012
NOV15b   NCTAG----------AACDAVNGSCLCPAGRRGPRCAESACPAHTYGHNCSQACACFNGA 1006
NOV15c   NCTAG----------AACDAVNGSCLCPAGRRGPRCAET--------------------  985
NOV15d   DCGGG----------ADCDPVSGQCHCVDGYMGPTCREG--------------------  135
NOV15e   NCTAG----------AACDAVNGSCLCPAGRRGPRCAET-CPAHTYGHNCSQACACFNGA 1011
NOV15f   NCTAG----------AACDAVNGSCLCPAGRRGPRCAESACPAHTYGHNCSQACACFNGA 1016
O88281   NCSAG----------APCDAVTGSCICPAGRWGPRCAQS-CPPLTFGLNCSQICTCFNGA 1013
Q9TVQ2   DCTTTNDTSMYNPFVARCDHVTGECRCPAGWTGPDCQTS-CPLGRHGEGCRHSCQCSNGA 1091
T27283   DCTTTNDTSMYNPFVARCDHVTGECRCPAGWTGPDCQTS-CPLGRHGEGCRHSCQCSNGA 1158
Q96KG6   SCANN----------GTCSPIDGSCQCFPGWIGKDCSQA-CPPGFWGPACFHACSCHNGA  641
Q96KG7   TCINN----------GTCNPIDRSCQCYPGWIGSDCSQP-CPPAHWGPNCIHTCNCHNGA  722
```

```
              1210      1220      1230      1240      1250      1260
NOV15a   SCDPVHGQCHCAPGWMGPSCLQACPAGLYGDNCRHSCLCQNGGTCDPVSGHCACPEGWAG 1072
NOV15b   SCDPVHGQCHCAPGWMGPSCLQACPAGLYGDNCRHSCLCQNGGTCDPVSGHCACPEGWAG 1066
NOV15c   -------------------CPAGLYGDNCRHSCLCQNGGTCDPVSGHCACPEGWAG     1022
NOV15d   -------------CP--LR------------LPENP----------SLAQGSAG        152
NOV15e   SCDPVHGQCHCAPGWMGPSCLQACPAGLYGDNCRHSCLCQNGGTCDPVSGHCACPEGWAG 1071
NOV15f   SCDPVHGQCHCAPGWMGPSCLQACPAGLYGDNCRHSCLCQNGGTCDPVSGHCACPEGWAG 1076
O88281   SCDSVTGQCHCAPGWMGPTCLQACPPGLYGKNCQHSCLCRNGGRCDPILGQCTCPEGWTG 1073
Q9TVQ2   SCDRVTGFCDCPSGFMGKNCESECPEGLWGSNCMKHCLCMHGGECNKENGDCECIDGWTG 1151
T27283   SCDRVTGFCDCPSGFMGKNCESECPEGLWGSNCMKHCLCMHGGECNKENGDCECIDGWTG 1218
Q96KG6   SCSAEDGACHCTPGWTGLFCTQRCPAAFFGKDCGRVCQCQNGASCDHISGKCTCRTGFTG  701
Q96KG7   FCSAYDGECKCTPGWTGLYCTQRCPLGFYGKDCALICQCQNGADCDHISGQCTCRTGFMG  782
```

```
              1270      1280      1290      1300      1310      1320
NOV15a   LACEVECLPRDVRAGCRHSGGCLNGGLCDPHTGRCLCPAGWTGDKCQSPAACAKGTFGPH 1132
NOV15b   LACEVECLPRDVRAGCRHSGGCLNGGLCDPHTGRCLCPAGWTGDKCQSPAACAKGTFGPH 1126
NOV15c   LACEKECPPRDVRAGCRHSGGCLNGGLCDPHTGRCLCPAGWAGDKCQSP----------  1071
NOV15d   ------TLPASSRPTSRSG----G------------PARH------------------   170
NOV15e   LACEVECLPRDVRAGCRHSGGCLNGGLCDPHTGRCLCPAGWTGDKCQSPAACAKGTFGPH 1131
NOV15f   LACEVECLPRDVRAGCRHSGGCLNGGLCDPHTGRCLCPAGWTGDKCQSPAACAKGTFGPH 1136
O88281   LACENECLPGHYAAGCQLNCSCLEGICDRLTGHCLCPAGWTGDKCQS--SCVSGTFGVH  1131
Q9TVQ2   PSCEFLCPFGQFGRNCAQRCNCKNGASCDRKTGRCECLPGWSGEHCEK--SCVSGHYGAK 1209
T27283   PS---LCPFGQFGRNCAQRCNCKNGASCDRKTGRCECLPGWSGEHCEK--SCVSGHYGAK 1273
Q96KG6   QHCEQRCAPGTFGYGCQQLCECMNNSTCDHVTGTCYCSPGFKGIRCDQA-ALMMEELNPY  760
Q96KG7   RHCEQKCPSGTYGYGCRQICDCLNNSTCDHITGTCYCSPGWKGARCDQAGVIIVGNLNSL  842
```

```
              1330      1340      1350      1360      1370      1380
```

```
NOV15a    CEGRCAC-RWGGPCHLATGACLCPPGWRGPHLSAACLRGWFGEACAQRCSCPPGAACHHV  1191
NOV15b    CEGRCAC-RWGGPCHLATGACLCPPGWRGPHLSAACLRGWFGEACAQRCSCPPGAACHHV  1185
NOV15c    ----------------------------------CLRGWFGEACAQHCSCPPGAACHHV  1096
NOV15d    ------------------------------------------------------------  170
NOV15e    CEGRCAC-RWGGPCHLATGACLCPPGWRGPHLSAACLRGWFGEACAQRCSCPPGAACHHV  1190
NOV15f    CEGRCAC-RWGGPCHLATGACLCPPGWRGPHLSAACLRGWFGEACAQRCSCPPGAACHHV  1195
O88281    CEEHCAC-RKGASCHHVTGACFCPPGWRGPHCEQACPRGWFGEACAQRCLCPTNASCHHV  1190
Q9TVQ2    CEETCEC-ENGALCDPISGHCSCQPGWRGKKCNRPCLKGYFGRHCSQSCRCANSKSCDHI  1268
T27283    CEETCEC-ENGALCDPISGHCSCQPGWRGKKCNRPCLKGYFGRHCSQSCRCANSKSCDHI  1332
Q96KG6    TKISPALGAERHSVGAVTGIMLLLFFIVVLLGLFAWHRRRQKEKGRDLAPRVSYTPAMRM  820
Q96KG7    SRTSTALPADSYQIGAIAGIIILVLVVLFLLALFIIYRHKQKGK-ESSMPAVTYTPAMRV  901

1390      1400      1410      1420      1430      1440
                   ....|....|....|....|....|....|....|....|....|....|....|....|
NOV15a    TGACRCPPGFTGSGCEQACPPGSF-GEDCAQMCQCPGENPACHPATGTCS----------  1240
NOV15b    TGACRCPPGFTGSGCEQACPPGSF-GEDCAQMCQCPGENPACHPATGTCS----------  1234
NOV15c    TGACRCPPGFTGSGCEQGCPPG--------------------------------------  1118
NOV15d    ------------------------------------------------------------  170
NOV15e    TGACRCPPGFTGSGCEQACPPGSF-GEDCAQMCQCPGENPACHPATGTCS----------  1239
NOV15f    TGACRCPPGFTGSGCEQACPPGSF-GEDCAQMCQCPGENPACHPATGTCS----------  1244
O88281    TGECRCPPGFTGLSCEQACQPGTF-GKDCEHLCQCPGETWACDPASGVCT----------  1239
Q9TVQ2    SGRCCPKGYAGHSCTELCPDGTF-GESCSQKCDCG-ENSMCDAISGKCF-----------  1316
T27283    SGRCCPKGYAGHSCTELCPDGTF-GESCSQKCDCG-ENSMCDAISGKCF-----------  1380
Q96KG6    TSTDYSLS----------------------------------------------------  828
Q96KG7    VNADYTISGTLPHSNGGNANSHYFTNPSYHTLTQCATSPHVNNRDRMTVTKSKNNQLFVN  961

1450      1460      1470      1480      1490      1500
                   ....|....|....|....|....|....|....|....|....|....|....|....|
NOV15a    ---CAAGYHG--PSCQQRC-PPGRYGPGCEQLCG-CLNGGSCDAATGACRCPTGFLGTDC  1293
NOV15b    ---CAAGYHG--PSCQQRC-PPGRYGPGCEQLCG-CLNGGSCDAATGACRCPTGFLGTDC  1287
NOV15c    -----------------------RYGPGCEQLCG-CLNGGSCDAATGACRCPTGFLGTDC  1154
NOV15d    ------------------------------------------------------------  170
NOV15e    ---CAAGYHG--PSCQQRC-PPGRYGPGCEQLCG-CLNGGSCDAATGACRCPTGFLGTDC  1292
NOV15f    ---CAAGYHG--PSCQQRC-PPGRYGPGCEQLCG-CLNGGSCDAATGACRCPTGFLGTDC  1297
O88281    ---CAAGTHG--TGCLQRC-PSGRYGPGCEHLCK-CLNGGTCDPATGACYCPAGFLGADC  1292
Q9TVQ2    ---CKPGHSG--SDCKSGC-VQGRYGPDCNQLCS-CENGGVCDSSTGSCVCPPGYIGTKC  1369
T27283    ---CKPGHSG--SDCKSGC-VQGRYGPDCNQLCS-CENGGVCDSSTGSCVCPPGYIGTKC  1433
Q96KG6    ------------GACG----MDRRQNTYI-----------MDKGFKDYMKESVCSSSTC  860
Q96KG7    LKNVNPCKRGPVGDCTGTLPADWKHGGYLNELGAFGLDRSYMGKSLKDLGKNSEYNSSNC  1021

1510      1520      1530      1540      1550      1560
                   ....|....|....|....|....|....|....|....|....|....|....|....|
NOV15a    NLTCPQGRFGPNCTHVCGCGCGAACDPVTGTCLCPPGRAGVRCERGCPQNRFGVGCEHTC  1353
NOV15b    NLTCPQGRFGPNCTHVCGCGCGAACDPVTGTCLCPPGRAGVRCERGCPQNRFGVGCEHTC  1347
NOV15c    NLTCPQGRFGPNCTHVCGCGCGAACDPVTGTCLCPPGRAGVRCERGCPQNRFGVGCEHTC  1214
NOV15d    ------------------------------------------------------------  170
NOV15e    NLTCPQGRFGPNCTHVCGCGCGAACDPVTGTCLCPPGRAGVRCERGCPQNRFGVGCEHTC  1352
NOV15f    NLTCPQGRFGPNCTHVCGCGCGAACDPVTGTCLCPPGRAGVRCERGCPQNRFGVGCEHTC  1357
O88281    SLACPQGRFGPSCAHVCACRCGAACDPVSGACICSPGKTGVRCEHGCPQDRFGKGCELKC  1352
Q9TVQ2    ETACQSDRFGPTCEKICNCENGGTCDRLTGQCRCLPGFTGMTCNQVCPEGRFGAGCKEKC  1429
T27283    ETACQSDRFGPTCEKICNCENGGTCDRLTGQCRCLPGFTGMTCNQVCPEGRFGAGCKEKC  1493
Q96KG6    SLNSSENPYATIKDPPILTCKLPESSYVEMKSPVHMGSPYTDVPSLSTSNKNIYEVEPTV  920
Q96KG7    SLSSSENPYATIKDPPVLIPKSSECGYVEMKSPARRDSPYAEINNSTSANRNVYEVEPTV  1081

1570      1580      1590      1600      1610      1620
                   ....|....|....|....|....|....|....|....|....|....|....|....|
NOV15a    SCRNGGLCHASKR----------QLLLWPGLDGAALRAGLSPWALRSRLPSG-----  1395
```

```
NOV15b   SCRNGGLCHASKR-------------QLLLWPGLDGAALRAGLSPWALRSRLPSG-----  1389
NOV15c   SCRNGGLCHASNGSCSCGLGWTGRHCELACPPGRYGAACHLECSCHNNSTGEPATGTCRC  1274
NOV15d   ------------------------------------------------------------  170
NOV15e   SCRNGGLCHASKR-------------QLLLWPGLDGAALRAGLSPWALRSRLPSG-----  1394
NOV15f   SCRNGGLCHASNGSCSCGLGWTGRHCELACPPGRYGAACHLECSCHNNSTCEPATGTCRC  1417
O88281   ACRNGGLCHAINGSCSCPLGWMGPHCEHACPAGRYGAACLLECFCQNNGSCEPTTGACLC  1412
Q9TVQ2   RCANG-HCNASSGECKCNLGFTGPSCEQSCPSGKYGLNCTLDCECYGQARCDPVQGCCDC  1488
T27283   RCANG-HCNASSGECKCNLGFTGPSCEQSCPSGKYGLNCTLDCECYGQARCDPVQGCCDC  1552
Q96KG6   SVVQEGCGENSSYIQ----------NAYDLPRNSHIPGHYDLLPVRQSPAN--------  961
Q96KG7   SVVQGVFSNNGRLSQ----------DPYDLPKNSHIPCHYDLLPVRDSSSSPKQ---E-  1126

1630      1640      1650      1660      1670      1680
              ....|....|....|....|....|....|....|....|....|....|....|....|
NOV15a   ------------------------------------VLLPQQQHV----------  1404
NOV15b   ------------------------------------VLLPQQQHV----------  1398
NOV15c   GPGFYGQACEHPCPPGFHGAGCQGLCWCQHGAPCDPISGRCLCPAGFHGHFCERGCEPGS  1334
NOV15d   ------------------------------------------------------------  170
NOV15e   ------------------------------------VLLPQQQHV----------  1403
NOV15f   GPGFYGQACEHPCPPGFHGAGCQGLCWCQHGAPCDPISGRCLCPAGFHGHFCERGCEPGS  1477
O88281   GPGFYGQACEHSCPSGFHGPGCQRVCECQQGAPCDPVSGQCLCPAGFHGQFCEKGCESGS  1472
Q9TVQ2   PPGRYGSRCQFSCPNGFYGWYCSQSCSCQNGAHCDGADGRCLCPAGFQVKLANKKKNDLE  1548
T27283   PPGRYGSRCQFSCPNGFYGWYCSQSCSCQNGAHCDGADGRCLCPAGFQVKLANKKKNDLE  1612
Q96KG6   ------------------------------GPSQDKQS----------  969
Q96KG7   ------------------------------D--SG---GSSSNSSSSSE-------  1140

1690      1700      1710      1720      1730      1740
              ....|....|....|....|....|....|....|....|....|....|....|....|
NOV15a   ------------------------------------------------------------  1404
NOV15b   ------------------------------------------------------------  1398
NOV15c   FGEGCHQRCDCDGG-----------APCDPVTGLCLCPPGRSGATCNLDCRRGQFGPSC  1382
NOV15d   ------------------------------------------------------------  170
NOV15e   ------------------------------------------------------------  1403
NOV15f   FGEGCHQRCDCDGG-----------APCDPVTGLCLCPPGRSGATCNLDCRRGQFGPSC  1525
O88281   FGDGCLQQCNCHTG-----------VPCDPISGLCLCPPGRTGAACDLDCRRGRFGPGC  1520
Q9TVQ2   LGDKCEQKCSEGSFGPACSQQCNCGKYKCDATDGKCICPVGRHGPLCEEECRPGRYGQSC  1608
T27283   LVQNIEFF----------------------------------------------------  1620
Q96KG6   ------------------------------------------------------------  969
Q96KG7   ------------------------------------------------------------  1140

1750      1760      1770      1780      1790      1800
              ....|....|....|....|....|....|....|....|....|....|....|....|
NOV15a   ------------------------------------------------------------  1404
NOV15b   ------------------------------------------------------------  1398
NOV15c   TLHCDCGGGADCDPVSGQCHCVDGYMGPTCREGGPLRLPENPSLAQGSAGTLPASSRPTS  1442
NOV15d   ------------------------------------------------------------  170
NOV15e   ------------------------------------------------------------  1403
NOV15f   TLHCDCGGGADCDPVSGQCHCVDGYMGPTCREAG---------------TLPASSRPTS  1569
O88281   ALRCDCGGGADCDPISGQCHCVDSYMGPTCREVP---------------TQISSSRPAP  1564
Q9TVQ2   QNKCQCFNGATCDARTGQCSCSPGWLGPTCQIEMMDP------------NNVANRGDLP  1655
T27283   ------------------------------------------------------------  1620
Q96KG6   ------------------------------------------------------------  969
Q96KG7   ------------------------------------------------------------  1140

1810
              ....|....|
NOV15a   ----------  1404
NOV15b   ----------  1398
```

| | | |
|---|---|---|
| NOV15c | RSGGPARH-- | 1450 |
| NOV15d | ---------- | 170 |
| NOV15e | ---------- | 1403 |
| NOV15f | RSGGPARH-- | 1577 |
| O88281 | QHPSSRAMKH | 1574 |
| Q9TVQ2 | EDWEWRKKR- | 1664 |
| T27283 | ---------- | 1620 |
| Q96KG6 | ---------- | 969 |
| Q96KG7 | ---------- | 1140 |

The presence of identifiable domains in the disclosed NOV15 protein was determined by using Pfam and then determining the Interpro number. The results are listed in Table 15P with the statistics and domain description.

and their encoded polypeptides include structural motifs that are characteristic of proteins belonging to the MEGF family. Proteins belonging to the MEGF/Fibrillin family of proteins share a common feature of having epidermal growth factor

TABLE 15P

Domain Analysis of NOV15

| PSSMs Producing Significant Alignments | Score (bits) | E Value |
|---|---|---|
| EGF: domain 2 of 27, from 168 to 203 | 38.8 | 1.2e-07 |

```
EGF      Capnn.pCsngGtCvntpggssdnfggytCeCppGdyylsytGkrC      (SEQ ID NO:216)
         |  ++++|++  +|+++++           ++  |+|++|  ++++ + ++|
NOV15    CRTHNgGCQH--RCVNTPG-------SYLCECKPG-FRLHTDSRTC      (SEQ ID NO:44)
```

| EGF: domain 3 of 27, from 208 to 244 | 34.2 | 3e-06 |
|---|---|---|

```
EGF      Capnn.pCsngGtCvntpggssdnfggytCeCppGdyylsytGkrC      (SEQ ID NO:217)
         |++++++|++    |+ +         + ++|+|  +|  ++++ +|++|
NOV15    CALGNgGCQH--HCVQLTI------TRHRCQCRPG-FQLQEDGRHC      (SEQ ID NO:44)
```

| EGF: domain 4 of 27, from 250 to 285 | 33.9 | 3.7e-06 |
|---|---|---|

```
EGF      Capnn.pCsngGtCvntpggssdnfggytCeCppGdyylsytGkrC      (SEQ ID NO:218)
         |+  ++ |++  +|+ +++          +|+|++|  ++++ +|+ |
NOV15    CANRNgSCMH--RCQVVRG-------LARCECHVG-YQLAADGKAC      (SEQ ID NO:44)
```

| EGF: domain 5 of 27, from 291 to 326 | 29.5 | 7.9e-05 |
|---|---|---|

```
EGF      Capnn.pCsngGtCvntpggssdnfggytCeCppGdyylsytGkrC      (SEQ ID NO:219)
         |+ +    | +   |+++ +         +++|+|+ |  ++++ +|++|
NOV15    CAAGLaQCAH--GCLNTQG-------SFKCVCHAG-YELGADGRQC      (SEQ ID NO:44)
```

Consistent with other known members of the MEGF6 family of proteins, NOV15 contains an epithelial growth factor (EGF) domain as illustrated in Table 15P.

NOV15 nucleic acids, and the encoded polypeptides, according to the invention are useful in a variety of applications and contexts. For example, NOV15 nucleic acids and polypeptides can be used to identify proteins that are members of the EGF family of proteins. The NOV15 nucleic acids and polypeptides can also be used to screen for molecules, which inhibit or enhance NOV15 activity or function. Specifically, the nucleic acids and polypeptides according to the invention may be used as targets for the identification of small molecules that modulate or inhibit, e.g., cell adhesion or receptor-ligand interactions. These molecules can be used to treat, e.g., neurodegenerative disorders such as Alzheimers or Parkinson's disease, or connective tissue disorders such as Marfan syndrome.

In addition, various NOV15 nucleic acids and polypeptides according to the invention are useful, inter alia, as novel members of the protein families according to the presence of domains and sequence relatedness to previously described proteins. For example, the NOV15 nucleic acids (EGF)-like motifs. Examples of proteins containing EGF-like motifs include the MEGF proteins, which are expressed in the brain and are involved in neural development and function, the fibrillins, which are involved in extracellular matrix structure and maintenance, and the notch proteins (MEGF6), which are thought to be involved in mediating cell-fate decisions during hematopoiesis and neural development. Thus, such proteins play a critical role in a number of extracellular events, including cell adhesion and receptor-ligand interactions. Defects in these proteins can have profound effects on cellular and extracellular physiology and structure. For example, a mutation in fibrillin 1 causes Marfan syndrome, a disease that involves connective tissue, bone and lung manifestations.

The NOV15 nucleic acids and polypeptides, antibodies and related compounds according to the invention will be useful in therapeutic and diagnostic applications in the mediation of cellular and extracellular physiology. As such the NOV15 nucleic acids and polypeptides, antibodies and related compounds according to the invention may be used to treat, e.g., cancer, trauma, bacterial and viral infections, regeneration (in vitro and in vivo), fertility, endometriosis, cardiomyopathy, atherosclerosis, hypertension, congenital heart defects, aortic stenosis, atrial septal defect (ASD), atrioventricular (A-V) canal defect, ductus arteriosus, pulmonary stenosis, subaortic stenosis, ventricular septal defect (VSD), valve diseases, tuberous sclerosis, scleroderma, obesity, transplantation, anemia, bleeding disorders, transplantation, diabetes, autoimmune disease, renal artery stenosis, interstitial nephritis, glomerulonephritis, polycystic kidney disease, systemic lupus erythematosus, renal tubular acidosis, IgA nephropathy, hypercalceimia, Lesch-Nyhan syndrome, systemic lupus erythematosus, autoimmune disease, asthma, emphysema, allergy, ARDS, von Hippel-Lindau (VHL) syndrome, Alzheimer's disease, stroke, hypercalceimia, Parkinson's disease, Huntington's disease, cerebral palsy, epilepsy, Lesch-Nyhan syndrome, multiple sclerosis, ataxia-telangiectasia, leukodystrophies, behavioral disorders, addiction, anxiety, pain, neurodegeneration, Hirschsprung's disease, Crohn's Disease, and appendicitis.

The NOV15 nucleic acids and polypeptides are useful for detecting specific cell types. For example, expression analysis has demonstrated that a NOV15 nucleic acid is expressed in: brain, colon, frontal lobe, heart, kidney, lung, mammary gland/breast, ovary, prostate, and vein. Additional utilities for NOV15 nucleic acids and polypeptides according to the invention are disclosed herein.

NOV16

The disclosed NOV16 nucleic acid (alternatively referred to herein as AL359846_A_da1) encodes a novel G-protein coupled receptor (GPCR)-like protein and includes the 990 nucleotide sequence (SEQ ID NO:55) shown in Table 16A. The NOV16 nucleic acid disclosed herein maps to chromosome 4.

An open reading frame for the mature protein was identified beginning with an ATG initiation codon at nucleotides 3–5, and ending with a TGA stop codon at nucleotides 945–947. Putative untranslated regions, if any, are found upstream from the initiation codon and downstream from the termination codon. The start and stop codons are in bold letters.

TABLE 16A

NOV16 Nucleotide Sequence (SEQ ID NO: 55)

ACATGGAGACAAGAAATTACTCTGCCATGACTGAATTCTTTCTGGTGGGCTTTCCCAATATCCAGAGCTCCAGC

TTTTTCTGTTCCTGCTCTGCCTCATCATGTACATGATAATCCTCCTGGGAAATAGCCTCCTCATTATCATCACCA

TCTTGGATTCTCGCCTCCATACTCCCATGTATTTCTTTCTTGGAAACCTCTCATTCTTGGACATCTGTTACACAT

CCTCATCCATTCCTCCAATGCTTATTATATTTATGTCTGAGAGAAAATCCATCTCCTTCATTGGCTGTGCTCTGC

AGATGGTTATGTCCCTTGGCTTGGGCTCCACTGAGTGTGTCCTCCTGGCTGTGATGGCCTATGACCACTATGTGG

CCATCTGCAACCCACTGAGGTACTCCATCATCATGAACGGAGTGCTGTATGTGCAAATGGCTGCATGGTCCTGGA

TCATAGGCTGTCTGACCTCCCTATTGCACACAGTTCTGACAATGATGTTGCCTTTCTGTGGGAATAATGTCATTG

ATCATATTACCTGTGAAATTTTGGCCCTTCTAAAACTTGTTTGTTCAGATATCACCATCAATGTGCTTATCATGA

CAGTGACAAATATTGTTTCACTGGTGATTCTTCTACTGTTAATTTTCATCTCCTATGTGTTTATTCTCTCTTCCA

TCCTGAGAATTAATTGTGCTGAGGGAAGAAAGAAAGCCTTCTCTACCTGTTCAGCGCACTCGATTGTGGTCATCT

TATTCTACGGTTCAGCCCTTTTTATGTACATGAAACCCAAGTCAAAGAACACTAATACATCTGATGAGATTATTG

GGCTGTCTTATGGAGTGGTAAGCCCAATGTTAAATCCCATCATCTATAGCCTCAGGAATAAAGAGGTCAAAGAGG

CTGTAAAGAAAGTCCTGAGCAGACATCTGCATTTATTGAAAATGTGAAAAACCTTGGGCATGCGATATCCTCAAT

GGGGCAAGAGAGCTT

The NOV16 protein (SEQ ID NO:56) encoded by SEQ ID NO:55 is 314 amino acid residues in length and is presented using the one-letter amino acid code in Table 16B. The SignalP, Psort and/or Hydropathy results indicate that NOV16 has a signal peptide and is likely to be localized at the plasma membrane with a certainty of 0.6000. Alternatively, a NOV16 polypeptide is located to the Golgi body with a certainty of 0.4000, the endoplasmic reticulum (membrane) with a certainty of 0.3000, or the microbody (peroxisome) with a certainty of 0.3000. The SignalP indicates a likely cleavage site for a NOV16 peptide between positions 43 and 44, i.e., at the dash in the sequence GNS-LL.

TABLE 16B

Encoded NOV16 Protein Sequence (SEQ ID NO: 56)

METRNYSAMTEFFLVGLSQYPELQLFLFLLCLIMYMIILLGNSLLIIITILDSRLHTPMYFFLGNLSFLDICYTS
SSIPPMLIIFMSERKSISFIGCALQMVMSLGLGSTECVLLAVMAYDHYVAICNPLRYSIIMNGVLYVQMAAWSWI
IGCLTSLLHTVLTMMLPFCGNNVIDHITCEILALLKLVCSDITINVLIMTVTNIVSLVILLLLIFISYVFILSSI
LRINCAEGRKKAFSTCSAHSIVVILFYGSALFMYMKPKSKNTNTSDEIIGLSYGVVSPMLNPIIYSLRNKEVKEA
VKKVLSRHLHLLKM

A search against the Patp database, a proprietary database that contains sequences published in patents and patent publication, yielded several homologous proteins shown in Table 16C.

TABLE 16C

PatP Results for NOV16

| Sequences Producing High-Scoring Segment Pairs: | High Score | Smallest Sum Prob P (N) |
|---|---|---|
| patp: AAU24629 Human olfactory receptor AOLFR123 | 1575 | 1.6e-161 |
| patp: AAG71424 Human olfactory receptor polypeptide | 1569 | 6.8e-161 |
| patp: AAG72315 Human olfactory receptor polypeptide | 1377 | 1.5e-140 |
| patp: AAG71954 Human olfactory receptor polypeptide | 1028 | 1.4e-103 |
| patp: AAG72652 Murine OR-like polypeptide query sequence | 991 | 1.2e-99 |

In a BLAST search of public sequence databases, it was found, for example, that the NOV16 nucleic acid sequence of this invention has 555 of 804 bases (69%) identical to a gb:GENBANK-ID:MMU133424|acc:AJ133424.1 mRNA from Mus musculus or 37a gene. Further, the full amino acid sequence of the disclosed NOV16 protein of the invention has 189 of 313 amino acid residues (60%) identical to, and 246 of 313 amino acid residues (78%) similar to, the 318 amino acid residue ptnr:SPTREMBL-ACC:Q9QZ21 protein from Mouse (OLFACTORY RECEPTOR).

The NOV16 protein of the invention also has homolgy to the proteins shown in the BLASTP data in Table 16D.

TABLE 16D

NOV16 BLASTP Results

| Gene Index/ Identifier | Protein/Organism | Length of aa | Identity (%) | Positives (%) | Expect Value |
|---|---|---|---|---|---|
| Q9QZ21 | OLFACTORY RECEPTOR - Mus musculus (Mouse) | 318 | 189/313 (60%) | 246/313 (78%) | 5.2e-99 |
| Q9QZ22 | OLFACTORY RECEPTOR - Mus musculus (Mouse) | 319 | 190/317 (59%) | 250/317 (78%) | 1.8e-98 |
| Q9QZ20 | OLFACTORY RECEPTOR - Mus musculus (Mouse) | 318 | 187/312 (59%) | 244/312 (78%) | 2.9e-98 |
| Q9QZ19 | OLFACTORY RECEPTOR - Mus musculus (Mouse) | 319 | 187/314 (59%) | 246/314 (78%) | 1.6e-97 |
| Q9NQN1 | Olfactory receptor 2S2 - Homo sapiens (Human) | 319 | 187/312 (59%) | 245/312 (78%) | 3.8e-96 |

A multiple sequence alignment is given in Table 16E, with the NOV16 protein of the invention being shown in line 1 in a ClustalW analysis comparing NOV16 with related protein sequences of Table 16D.

Table 16E. ClustalW Analysis of NOV16

1. SEQ ID NO.: 56    NOV16
2. SEQ ID NO.: 220    Q9QZ21
3. SEQ ID NO.: 221    Q9QZ22
4. SEQ ID NO.: 222    Q9QZ20
5. SEQ ID NO.: 223    Q9QZ19
6. SEQ ID NO.: 224    Q9NQN1

```
                10        20        30        40        50        60
       ....|....|....|....|....|....|....|....|....|....|....|....|
NOV16  METRNYSA-MTEFFLVGLSQYPELQLFLFLLCLIMYMIILLGNSLLILIIILDSRLHTPM 59
Q9QZ21 MEGANQST-VAEFVLLGLSDHPKLEKTFFVLILLMYLVILLGNGVLILVSILDSHLHTPM 59
Q9QZ22 MDRSNETAPLSGFLLLGLSAHPKLEKTFFVLILMMYLVILLGNGVLILVSILDSHLHTPM 60
Q9QZ20 MDVSNQTT-VIEFVLLGLSAHPKLEKTFFVLILSMYLVILLGNGVLILVSILDSHLHTPM 59
```

```
                                                                               253                                           254

Q9QZ19    MERSNKTTPVSSFLLGLSAHPKLEKTFFVLILMYLVILLGNVVLILVSILDSHLHTPM    60
Q9NQN1    MEKANETSPVMGFVLLRLSAHPELEKTFFVLILMYLVILLGNGVLILVTILDSRLHTPM    60

70        80        90       100       110       120
                   |         |         |         |         |         |
NOV16     YFFLGNLSFLDICYTSSSIPPVLIIFMSERKSISFIGCALQMVMSLGLGSTECVLLAVMA   119
Q9QZ21    YFFLGDLSFLDICYTTSSIPLVLDGFLTPRKTISFSGCAVQMFLSFAMGATECVLLGMMA   119
Q9QZ22    YFFLGNLSFLDICYTTSSVPLILDSFLTPRKTISFSGCAVQMFLSFAMGATECVLLGMMA   120
Q9QZ20    YFFLGNLSFLDICYTTSSVPLVLDGFLTPRKTISFSGCAVQMFLSFAMGATECVLLSMMA   119
Q9QZ19    YFFLGNLSFLDICYTTSSVPLILDSFLTPRKTISFSGCAVQMFLSFAMGATECVLLGMMA   120
Q9NQN1    YFFLGNLSFLDICFTTSSVPLVLDSFLTPQETISFSACAVQMALSFAMGATECLLLSMMA   120

130       140       150       160       170       180
                   |         |         |         |         |         |
NOV16     YDHYVAICNPLRYSIIMNGVLYVQMAAWSWLIGCLTSLLHTVLTMMLPFCGNNVIDHITC   179
Q9QZ21    FDRYVAICNPLRYPVVMNKSAYVPMAVSSWVAGGANSLVQISLAVQLPFCGDNVINHFTC   179
Q9QZ22    FDRYVAICNPLRYPVVMNKAAYVPMAASSWAGGITNSVVQTSLAMRLPFCGDNVINHFTC   180
Q9QZ20    FDRYVAICNPLRYPVVMNKAAYVPMAVSSWVAGGANSLVQISLAVQLPFCGDNVINHFIC   179
Q9QZ19    FDRYVAICNPLRYPVVMSKAAYVPMAAGSWVSGSITATVQISLAMTLPFCGDNVINHFTC   180
Q9NQN1    FDRYVAICNPLRYSVIMSKAAYMPMAASSWAIGGAASVVHTSLAIQLPFCGDNVINHFTC   180

190       200       210       220       230       240
                   |         |         |         |         |         |
NOV16     EILALLKLVCSDIIINVLIMTVTNIVSLVILLLLIFISYVFILSSILRINCAEGRKKAFS   239
Q9QZ21    EILAVLKLACADISINVISMGVANVIFLGVPVLFIFVSYVFILVTILRIPSAEGRKKAFS   239
Q9QZ22    EILAVLKLACADISINVISMVVANMIFLAVPVLFIFVSYVFILVTILRIPSAEGRKKAFS   240
Q9QZ20    EILAVLKLACADISINVISMGVANVIFLGVPVLFIFVSYIFILSTILRIPSAEGRKKAFS   239
Q9QZ19    EILAVLKLACADISINVISMAVANAMFLGVPVLFIFVSYIFILSTILRIPSAEGRKKAFS   240
Q9NQN1    EILAVLKLACADISINVISMEVTNVIFLGVPVLFISFSYVFIMTILRIPSAEGRKKVFS   240

250       260       270       280       290       300
                   |         |         |         |         |         |
NOV16     TCSAHSIVVILFYGSALFMYMKPKSKN----T---NTSDEIIGLSYGVVSPMLNPIIYSLR   293
Q9QZ21    TCSAHLTVVIVFYGTILFMYGKPKSKDPLGADKQDVSDKLISLFYGVLTPMLNPIIYSLR   299
Q9QZ22    TCSAHLTVVIVFYGTILFMYGKPKSKDPLGADKQDLADKLISLFYGVVTPMLNPIIYSLR   300
Q9QZ20    TCSAHLTVVILFYGTILFMYGKPKSKDPLGADKQDLADKLISLFYGLLTPMLNPIIYSLR   299
Q9QZ19    TCSAHLTVVLVFYGTILFMYGKPKSKDPLGADKQDLADKLISLFYGVVTPMLNPIIYSLR   300
Q9NQN1    TCSAHLTVVIVFYGTLFFMYGKPKSKDSMGADKEDLSDKLIPLFYGVVTPMLNPIIYSLR   300

310       320
                   |         |
NOV16     NKEVKEAVKKVLSRHLHLLKM      314
Q9QZ21    NKDVKAAVRNLVG-QKCLIQ-      318
Q9QZ22    NKDVRAAVRNLVG-QKHLTE-      319
Q9QZ20    NKDVKAAVRNLAS-HRCLTF-      318
Q9QZ19    NKDVKAAVTNLVG-QKHFKW-      319
Q9NQN1    NKDVKAAVRRLLR-PKGFTQ-      319
```

The presence of identifiable domains in the disclosed NOV16 protein was determined by using Pfam and then determining the Interpro number. The results are listed in Table 16F with the statistics and domain description.

TABLE 16F

Domain Analysis of NOV16

| PSSMs Producing Significant Alignments | Score (bits) | E Value |
|---|---|---|
| 7tm_1: domain 1 of 1, from 41 to 290 | 132.9 | 3.7e-41 |

```
7tm_1      GNlLVilvilrtkklrtptnifilNLAvADLLflltlppwalyylvg
           GN+L i++ ++  +l+tp+++f++NL++ D++++ +  p++l++++
NOV16      GNSLLIIITILDSRLHTPMYFFLGNLSFLDICYTSSSIPPMLIIFMS 7tm_1      gsedWpfGsalCklvtaldvvnmyaSillLtaISiDRYlAIvhPlryrrr
            e++ ++ ++C l++ + +  + + +  lL+++++D Y+AI++Plry+ +
NOV16      --ERKSISFIGCALQMVMSLGLGSTECVLLAVMAYDHYVAICNPLRYSII 7tm_1      rtsprrAkvvillvWvlalllslPpllfswvktveegngtlnvnvtvCli
           ++    + + + +  W++++l  sl++ ++ ++ ++++gn++  +++++C i
NOV16      MN-GVLYVQMAAWSWIIGCLTSLLHTVL-TMMLPFCGNNV--IDHITCEI 7tm_1      dfpeestasvstwlrsyvllstlvgFllPllvilvcYtrIlrtlr.....
               ++s+ t  + + ++ ++v+ ++ ll+i + Y +Il  + + +
NOV16      LALLKLVCSDITINVLIMTVTNIVSLVILLLLIFISYVFILSSILrinca 7tm_1      ...kaaktllvvvvvFvlCWlPyfivllldtlc.lsiimsstCelervlp
           +++k a+ ++  ++++v++++  ++++++ +  +
NOV16      egrKKAFSTCSAHSIVVILFYGSALFMYMKPKSkN--------------T 7tm_1      tallvtlwLayvNsclNPiIY      (SEQ ID NO:225)
           ++ l +++v+++lNPiIY
NOV16      SDEIIGLSYGVVSPMLNPIIY      (SEQ ID NO:56)
```

Consistent with other known members of the GPCR family of proteins, NOV16 contains a 7-transmembrane (7tm_1) domain as illustrated in Table 16F.

The NOV16 nucleic acid, and the encoded polypeptide, according to the invention are useful in a variety of applications and contexts. For example, NOV16 nucleic acids and polypeptides can be used to identify proteins that are members of the GPCR family of proteins. The NOV16 nucleic acids and polypeptides can also be used to screen for molecules, which inhibit or enhance NOV16 activity or function. Specifically, the nucleic acids and polypeptides according to the invention may be used as targets for the identification of small molecules that modulate or inhibit, e.g., cell recognition or signal transduction. These molecules can be used to treat, e.g., taste and scent detectability disorders, weight disorders, immune diseases, or signal transduction pathways.

In addition, the NOV16 nucleic acid and polypeptide according to the invention are useful, inter alia, as novel members of the protein families according to the presence of domains and sequence relatedness to previously described proteins. For example, the NOV16 nucleic acid and polypeptide include structural motifs that are characteristic of proteins belonging to the family of GPCR proteins. The human GPCR genes are generally intron-less and belong to four gene subfamilies, displaying great sequence variability. These genes are dominantly expressed in olfactory epithelium. Olfactory receptors (ORs) have been identified as extremely large family of GPCRs in a number of species. As members of the GPCR family, these receptors share a seven transmembrane domain structure with many neurotransmitter and hormone receptors, and are likely to underlie the recognition and G-protein-mediated transduction of odorant signals. Like GPCRs, the ORs they can be expressed in a variety of tissues where they are thought to be involved in recognition and transmission of a variety of signals.

The NOV16 nucleic acid and polypeptide, antibodies and related compounds according to the invention will be useful in therapeutic and diagnostic applications in the mediation of signal transduction. As such the NOV16 nucleic acid and polypeptide, antibodies and related compounds according to the invention may be used to treat, e.g., developmental diseases, MHCII and III diseases (immune diseases), taste and scent detectability disorders, Burkitt's lymphoma, corticoneurogenic disease, signal transduction pathway disorders, retinal diseases including those involving photoreception, cell growth rate disorders, cell shape disorders, feeding disorders, control of feeding, potential obesity due to overeating, potential disorders due to starvation (lack of apetite), noninsulin-dependent diabetes mellitus (NIDDM1), bacterial, fungal, protozoal and viral infections (particularly infections caused by HIV-1 or HIV-2), pain, cancer (including but not limited to Neoplasm; adenocarcinoma; lymphoma; prostate cancer; uterus cancer), anorexia, bulimia, asthma, Parkinson's disease, acute heart failure, hypotension, hypertension, urinary retention, osteoporosis, Crohn's disease, multiple sclerosis, angina pectoris, myocardial infarction, ulcers, asthma, allergies, benign prostatic hypertrophy, or psychotic and neurological disorders, including anxiety, schizophrenia, manic depression, delirium, dementia, and severe mental retardation.

The NOV16 nucleic acid and polypeptide are useful for detecting specific cell types. For example, expression analysis has demonstrated that a NOV16 nucleic acid is expressed in olfactory neuroepithelium and the heart.

Additional utilities for the NOV16 nucleic acid and polypeptide according to the invention are disclosed herein.

NOV17

The NOV17 proteins descibed herein are novel transporter-like proteins. Two alternative novel NOV17 nucleic acids and polypeptides are disclosed herein, namely NOV17a and NOV17b.

NOV17a is directed to a transporter protein having a hydrophilic amino terminus containing sequences enriched in proline (P), glutamate (E), serine (S), and threonine (T), i.e., PEST-containing transporter. The NOV17a nucleic acid disclosed herein maps to chromosome 6.

NOV17b is directed to a Na+ independent aromatic amino acid transporter. The NOV17b nucleic acid maps to chromosome 5.

NOV17a

A NOV17 variant is NOV17a (alternatively referred to herein as CG56459-01), which encodes the 1875 nucleotide sequence (SEQ ID NO:57) shown in Table 17A. An open reading frame for the mature protein was identified beginning with an ATG codon at nucleotides 5–7 and ending with a TAA codon at nucleotides 1823–1825. Putative untranslated regions, if any, downstream from the termination codon and upstream from the initiation codon are underlined. The start and stop codons are in bold letters.

TABLE 17A

NOV17a Nucleotide Sequence (SEQ ID NO: 57)

GCTCATGCTTATGGGCGGGGTGACCCACACATCTGTGCCCCTCTCTGAGCAGGAGGAGGCCCCGTCGCAGACGCG

CGCGCAGACAGCGTCTGCCGCGGGCACCTGGGGCCGCGCGCCGCGGGGCGCCCCGCCTCCGCTCTCCGAGGCCCA

ATCATCTGGAGGCTGTGGGGGCACGTCCCGCTCCCGGCCACGCCCCAGCCGGCGGGGCGGGGCTCGCGTCCCT

CGCGCTTCTCCGGCGCCTGAGGGGCCCGCCTCGGGCCATGGTGCTCTCCCAGGAGGAGCCGGACTCCGCGCGGGG

CACGAGCGAGGCGCAGCCGCTCGGCCCCGCGCCCACGGGGGCCGCTCCGCCGCCCGGCCCGGGACCCTCGGACAG

CCCCGAGGCGGCTGTCGAGAAGGTGGAGGTGGAGCTGGCGGGGCCGGCGACCGCGGAGCCCCATGAGCCCCCGA

ACCCCCCGAGGGCGGCTGGGGCTGGCTGGTGATGCTGGCGGCCATGTGGTGCAACGGGTCGGTGTTCGGCATCCA

GAACGCTTGCGGGGTGCTCTTCGTGTCCATGCTGGAAACCTTCGGCTCCAAAGACGATGACAAGATGGTCTTTAA

GACAGCATGGGTAGGTTCTCTCTCCATGGGGATGATTTTCTTTTGCTGCCCAATAGTCAGCGTCTTCACAGACCT

ATTTGGTTGTCGGAAAACAGCTGTCGTGGGTGCTGCTGTTGGATTTGTTGGGCTCATGTCCAGTTCTTTTGTAAG

TTCCATCGAGCCTCTGTACCTTACCTATGGAATCATATTTGCCTGCGGCTGCTCCTTTGCATACCAGCCTTCATT

GGTCATTTTGGGACACTATTTCAAGAAGCGCCTTGGACTGGTGAATGGCATTGTCACTGCTGGCAGCAGTGTCTT

CACAATCCTGCTGCCTTTGCTCTTAAGGGTTCTGATTGACAGCGTGGGCCTCTTTTACACATTGAGGGTGCTCTG

CATCTTCATGTTTGTTCTCTTTCTGGCTGGCTTTACTTACCGACCTCTTGCTACCAGTACCAAAGATAAAGAGAG

TGGAGGTAGCGGATCCTCCCTCTTTTCCAGGAAAAAGTTCAGTCCTCCAAAAAAAATTTTCAATTTTGCCATCTT

CAAGGTGACAGCTTATGCAGTGTGGGCAGTTGGAATACCACTTGCACTTTTTGGATACTTTGTGCCTTATGTTCA

CTTGGTGAGTATGCTCCTTCACAAACATGTAAATGAAAGATTTCAAGATGAAAAAAATAAAGAGGTTGTTCTCAT

GTGCATTGGCGTCACTTCAGGAGTTGGACGACTGCTCTTTGGCCGGATTGCAGATTATGTGCCTGGTGTGAAGAA

GGTTTATCTACAGGTACTTTCCTTTTTCTTCATTGGTCTGATGTCCATGATGATTCCTCTGTGTAGCATCTTTGG

GGCCCTCATTGCTGTGTGCCTCATCATGGGTCTCTTCGATGGATGCTTCATTTCCATTATGGCTCCCATAGCCTT

TGAGTTAGTTGGTGCCCAGGATGTCTCCCAAGCAATTGGATTTCTGCTCGGATTCATGTCTATACCCATGACTGT

TGGCCCACCCATTGCAGGTTTACTTCGTGACAAACTGGGCTCCTATGATGTGGCATTCTACCTCGCTGGACTCCC

TCCCCTTATTGGAGGTGCTGTGCTTTGTTTTATCCCGTGGATCCATAGTAAGAAGCAAAGAGAGATCAGTAAAAC

CACTGGAAAAGAAAAGATGGAGAAAATGTTGGAAAACCAGAACTCTCTGCTGTCAAGTTCATCTGGAATGTTCAA

GAAAGAATCTGAGTCTATTATTTAATATCTTACATACCTCCACCAGACTGGACTTGCTTTTTGAATTTTCCGCAA

The NOV17a protein (SEQ ID NO:58) encoded by SEQ ID NO:57 is 606 amino acid residues in length and is presented using the one-letter amino acid code in Table 17B. The SignalP, Psort and/or Hydropathy results indicate that NOV17a has no known signal peptide and is likely to be localized at the plasma membrane with a certainty of 0.8000. Alternatively, a NOV17a polypeptide is located in the Golgi body with a certainty of 0.4000, the endoplasmic reticulum (membrane) with a certainty of 0.3000, or the mitochondrial inner membrane with a certainty of 0.0300.

TABLE 17B

Encoded NOV17a Protein Sequence (SEQ ID NO: 58)

MLMGGVTHTSVPLSEQEEAPSQTRAQTASAAGTWGRAPRGAPPPLSEAQSSGGCGGTSRSRPRPQPAGRGLASLA

LLRRLRGPPRAMVLSQEEPDSARGTSEAQPLGPAPTGAAPPPGPGPSDSPEAAVEKVEVELAGPATAEPHEPPEP

PEGGWGWLVMLAAMWCNGSVFGIQNACGVLFVSMLETFGSKDDDKMVFKTAWVGSLSMGMIFFCCPIVSVFTDLF

GCRKTAVVGAAVGFVGLMSSSFVSSIEPLYLTYGIIFACGCSFAYQPSLVILGHYFKKRLGLVNGIVTAGSSVFT

ILLPLLLRVLIDSVGLFYTLRVLCIFMFVLFLAGFTYRPLATSTKDKESGGSGSSLFSRKKFSPPKKIFNFAIFK

VTAYAVWAVGIPLALFGYFVPYVHLVSMLLHKHVNERFQDEKNKEVVLMCIGVTSGVGRLLFGRIADYVPGVKKV

YLQVLSFFFIGLMSMMIPLCSIFGALIAVCLIMGLFDGCFISIMAPIAFELVGAQDVSQAIGFLLGFMSIPMTVG

PPIAGLLRDKLGSYDVAFYLAGVPPLIGGAVLCFIPWIHSKKQREISKTTGKEKMEKMLENQNSLLSSSSGMFKK

ESDSII

SNP variants of NOV17a are disclosed in Example 2.

NOV17b

Alternatively, a NOV17 variant is NOV17b (alternatively referred to herein as CG56459-02), which includes the 1605 nucleotide sequence (SEQ ID NO:59) shown in Table 17C. An open reading frame for the mature protein was identified beginning with an ATG codon at nucleotides 31–33 and ending with a TAA codon at nucleotides 1576–1578. Putative untranslated regions, if any, downstream from the termination codon and upstream from the initiation codon are underlined. The start and stop codons are in bold letters.

TABLE 17C

NOV17b Nucleotide Sequence (SEQ ID NO: 59)

<u>CTCCGGCGCCTGAGGGGCCCGCCTCGGGCC</u>ATGGTGCTCTCCCAGGAGGAGCCGGACTCCGCGCGGGGCACGAGC

GAGGCGCAGCCGCTCGGCCCCGCGCCCACGGGGCCGCTCCGCCGCCCGGCCCGGGACCCTCGGACAGCCCCGAG

GCGGCTGTCGAGAAGGTGGAGGTGGAGCTGGCGGGGCCGGCGACCGCGGAGCCCCATGAGCCCCCCGAACCCCCC

GAGGGCGGCTGGGGCTGGCTGGTGATGCTGGCGGCCATGTGGTGCAACGGGTCGGTGTTCGGCATCCAGAACGCT

TGCGGGGTGCTCTTCGTGTCCATGCTGGAAACCTTCGGCTCCAAAGACGATGACAAGATGGTCTTTAAGACAGCA

TGGGTAGGTTCTCTCTCCATGGGGATGATTTTCTTTTGCTGCCCAATAGTCAGTGTCTTCACAGACCTATTTGGT

TGTCGGAAAACAGCTGTCGTGGGTGCTGCTGTTGGATTTGTTGGGCTCATGTCCAGTTCTTTTGTAAGTTCCATC

GAGCCTCTGTACCTTACCTATGGAATCATATTTGCCTGCGGCTGCTCCTTTGCATACCAGCCTTCATTGGTCATT

TTGGGACACTATTTCAAGAAGCGCCTTGGACTGGTGAATGGCATTGTCACTGCTGGCAGCAGTGTCTTCACAATC

CTGCTGCCTTTGCTCTTAAGGGTTCTGATTGACAGCGTGGGCCTCTTTTACACATTGAGGGTGCTCTGCATCTTC

ATGTTTGTTCTCTTTCTGGCTGGCTTTACTTACCGACCTCTTGCTACCAGTACCAAAGATAAAGAGAGTGGAGGT

AGCGGATCCTCCCTCTTTTCCAGGAAAAAGTTCAGTCCTCCAAAAAAAATTTTCAATTTTGCCATCTTCAAGGTG

ACAGCTTATGCAGTGTGGGCAGTTGGAATACCACTTGCACTTTTTGGATACTTTGTGCCTTATGTTCACTTGATG

AAACATGTAAATGAAAGATTTCAAGATGAAAAAAATAAAGAGGTTGTTCTCATGTGCATTGGCGTCACTTCAGGA

GTTGGACGACTGCTCTTTGGCCGGATTGCAGATTATGTGCCTGGTGTGAAGAAGGTTTATCTACAGGTACTCTCC

TTTTTCTTCATTGGTCTGATGTCCATGATGATTCCTCTGTGTAGCATCTTTGGGGCCCTCATTGCTGTGTGCCTC

ATCATGGGTCTCTTCGATGGATGCTTCATTTCCATTATGGCTCCCATAGCCTTTGAGTTAGTTGGTGCCCAGGAT

GTCTCCCAAGCAATTGGATTTCTGCTCGGATTCATGTCTATACCCATGACTGTTGGCCCACCCATTGCAGGTTTA

CTTCGTGACAAACTGGGCTCCTATGATGTGGCATTCTACCTCGCTGGAGTCCCTCCCCTTATTGGAGGTGCTGTG

CTTTGTTTTATCCCGTGGATCCATAGTAAGAAGCAAAGAGAGATCAGTAAAACCACTGGAAAAGAAAAGATGGAG

AAAATGTTGGAAAACCAGAACTCTCTGCTGTCAAGTTCATCTGGAATGTTCAAGAAAGAATCTGACTCTATTATT

TAA<u>TATCTTACATACCTCCACCAGACTGGA</u>

The NOV17b protein (SEQ ID NO:60) encoded by SEQ ID NO:59 is 515 amino acid residues in length and is presented using the one-letter amino acid code in Table 17D. The SignalP, Psort and/or Hydropathy results indicate that NOV17b has no known signal peptide and is likely to be localized at the plasma membrane with a certainty of 0.8000. Alternatively, a NOV17b polypeptide is located in the Golgi body with a certainty of 0.4000, the endoplasmic reticulum (membrane) with a certainty of 0.3000, or the mitochondrial inner membrane with a certainty of 0.0300.

TABLE 17D

Encoded NOV17b Protein Sequence (SEQ ID NO: 60)

MVLSQEEPDSARGTSEAQPLGPAPT-
GAAPPPGPGPSDSPEAAVEKVEVELAGPATAEPHEPPEPPEGGWGWLVML

AAMWCNGSVFGIQNACGVLFVSMLETFG-
SKDDDKMVFKTAWVGSLSMGMIFFCCPIVSVFTDLFGCRKTAVVGAA

VGFVGLMSSSFVSSIEPLYLTYGII-
FACGCSFAYQPSLVILGHYFKKRLGLVNGIVTAGSSVFTILLPLLLRVLI

DSVGLFKIFNFAIFKVTAYAVWAVGI-
PLALFGYGVPYVHLMKHVNERFQDEKNKEVVLMCIGVTSGVGRLLFGRI

ADYVPGVKKVYLQVLSFFFIGLMSMMI-
PLCSIFGALIAVCLIMGLFDGCFISIMAPIAFELVGAQDVSQAIGFLL

GFMSIPMTVGPPIAGLLRDKLGSYD-
VAFYLAGVPPLLIGGAVLCFIPWIHSKKQREISKTTGKEKMEKMLENQNS

LLSSSSGMFKKESDSII

NOV17 Clones

Unless specifically addressed as NOV17a or NOV17b, any reference to NOV17 is assumed to encompass all variants.

A search against the Patp database, a proprietary database that contains sequences published in patents and patent publication, yielded several homologous proteins shown in Table 17E.

TABLE 17E

PatP Results for NOV17

| Sequences Producing High-Scoring Segment Pairs: | High Score | Smallest Sum Prob P (N) |
|---|---|---|
| patp: AAE07068 Human gene 18 encoded secreted protein HKZCK47 | 712 | 4.4e-70 |
| patp: AAM93737 Human polypeptide | 308 | 1.5e-41 |
| patp: AAY31642 Human transport-associated protein-4 (TRANP-4) | 442 | 1.8e-41 |
| patp: AAB88570 Human hydrophobic domain containing protein clone HP03612 #34 | 297 | 2.5e-25 |
| patp: AAE06594 Human protein having hydrophobic domain, HP03949 | 162 | 6.3e-20 |

In a BLAST search of public sequence databases, it was found, for example, that the NOV17a nucleic acid sequence of this invention has 687 of 711 bases (96%) identical to a gb:GENBANK-ID):AF 116652|acc:AF116652.1 mRNA from Homo sapiens PRO0813 mRNA, complete cds. Further, the full amino acid sequence of the disclosed NOV17a protein of the invention was found to have 283 of 564 amino acid residues (50%) identical to, and 363 of 564 amino acid residues (64%) similar to, the 613 amino acid residue ptnr:SWISSPROT-ACC:P36021 protein from Human (X-LINKED PEST-CONTAINING TRANSPORTER).

In a similar BLAST search of public sequence databases, it was found, for example, that the NOV17b nucleic acid sequence of this invention has 1363 of 1605 bases (84%) identical to a gb:GENBANK-ID:AB047324|acc: AB047324.1 mRNA from Rattus norvegicus TAT1 mRNA, complete cds. Further the fall amino acid sequence of the disclosed NOV17b protein of the invention was found to have 435 of 515 amino acid residues (84%) identical to, and 463 of 515 amino acid residues (89%) similar to, the 514 amino acid residue ptnr:TREMBLNEW-ACC:BAB55595 protein from Rat (TAT1 PROTEIN).

Additional BLAST results are shown in Table 17F.

TABLE 17F

NOV17 BLASTP Results

| Gene Index/Identifier | Protein/Organism | Length of aa | Identity (%) | Positives (%) | Expect Value |
|---|---|---|---|---|---|
| Q91Y77 | TAT1 PROTEIN - Rattus norvegicus (Rat) | 514 | 434/520 (83%) | 464/520 (89%) | 1.6e-230 |
| P36021 | Monocarboxylate transporter 8 (MCT 8) (X-linked PEST-containing transporter) (MCT 7) - Homo sapiens (Human) | 613 | 283/564 (50%) | 363/564 (64%) | 7.7e-137 |
| O70324 | Monocarboxylate transporter 8 (MCT 8) (X-linked PEST-containing transporter) - Mus musculus (Mouse) | 565 | 264/492 (53%) | 340/492 (69%) | 1.3e-132 |
| Q9P1I2 | PRO0813 - Homo sapiens (Human) | 201 | 200/200 (100%) | 200/200 (100%) | 2.1e-102 |
| AAH17968 | HYPOTHETICAL 21.9 KDA PROTEIN - Homo sapiens (Human) | 201 | 198/200 (99%) | 199/200 (99%) | 2.4e-101 |

A multiple sequence alignment is given in Table 17G, with the NOV17 proteins of the invention being shown in lines 1 and 2 in a ClustalW analysis comparing NOV17 with related protein sequences of Table 17F.

Table 17G. ClustalW Analysis of NOV17

1. SEQ ID NO.: 58   NOV17a
2. SEQ ID NO.: 60   NOV17b
3. SEQ ID NO.: 226  Q91Y77
4. SEQ ID NO.: 227  P36021
5. SEQ ID NO.: 228  O70324
6. SEQ ID NO.: 229  Q9P1I2
7. SEQ ID NO.: 230  AAH17968

```
                       10         20         30         40         50         60
                ....|....|....|....|....|....|....|....|....|....|....|....|
NOV17a          ------MLMGGVTHTSVPLSEQEEAPSQTRAQTASAAGTWGRAPRGAPPPLSEAQSSGGC  54
NOV17b          ------------------------------------------------------------   1
Q91Y77          ------------------------------------------------------------   1
P36021          MGRGGGGLDVGGGGEGSRDRLSRDGLASWGAEPGGGGSGSGSSSPPSSSSCSSRNKYQPQ  60
O70324          -------------------------MALP------SPASEEAEGPCQEANQEYQEP     25
Q9P1I2          ------------------------------------------------------------   1
AAH17968        ------------------------------------------------------------   1

70         80         90        100        110        120
                ....|....|....|....|....|....|....|....|....|....|....|....|
```

265 266

```
NOV17a     GGTSRSRPRPQPAGRGLASLALLRRLRGPPRAMVLSQEEPDSAR-GTSEAQP---LGPAP    110
NOV17b     ------------------------------MVLSQEEPDSAR-GTSEAQP---LGPAP     24
Q91Y77     ------------------------------MVPSLEEPAAAERETNEAQP---PGPAP     25
P36021     SGSSGPSSHSPPAAMALQSQASEE-AKGPWQEADQEQQEPVGSPEPESEPEPEPEPEVP    119
O70324     VCS--PVPEPEPEPE------------PEPEPDPEP-VPVPPPEPQPEPEPQPLPDPAP     69
Q9P1I2     ----------------------------------------------------------      1
AAH17968   ----------------------------------------------------------      1

130       140       150       160       170       180
               ....|....|....|....|....|....|....|....|....|....|....|....|
NOV17a     TGAA------PPPGPGPSDSPEAAVEKVEVELAGPA----TAEPHEPPEPPEGGWGWLV    159
NOV17b     TGAA------PPPGPGPSDSPEAAVEKVEVELAGPA----TAEPHEPPEPPEGGWGWLV     73
Q91Y77     SDDA------PLPVPGPSDVSDGSVEKVEVELTR------STGNQEPPEPPEGGWGWLV     72
P36021     VPPP--EPQPEPQPLPDPAPLPELEFESERVHEPEPTPTVETRGTARGFQPPEGGFGWVV    177
O70324     LPELGFEAEPEPQPLPDPAPLPELGFEAEPVQEPEPTPTVETRGTARGFQPPEGGFGWVV    129
Q9P1I2     ----------------------------------------------------------      1
AAH17968   ----------------------------------------------------------      1

190       200       210       220       230       240
               ....|....|....|....|....|....|....|....|....|....|....|....|
NOV17a     MLAAMWCNGSVFGIQNACGVLFVSMLETFGSKDDDKMVFKTAWVGSLSMGMIFFCCPIVS    219
NOV17b     MLAAMWCNGSVFGIQNACGVLFVSMLETFGSKDDDKMVFKTAWVGSLSMGMIFFCCPIVS    133
Q91Y77     MLAAMWCNGSVFGIQNAYGVLFVSMLETFGAKDDDNMAFKAAWVGSLSMGMIFFCCPIVS    132
P36021     VFAATWCNGSIFGIHNSVGLLYSMLLEEEKEKNR-QVEFQAAWVGALAMGMIFFCSPIVS    236
O70324     VFAATWCNGSIFGIHNSVGLLYSMLLEEEKEKNR-QVEFQAAWVGALAMGMIFFCSPIVS    188
Q9P1I2     ----------------------------------------------------------      1
AAH17968   ----------------------------------------------------------      1

250       260       270       280       290       300
               ....|....|....|....|....|....|....|....|....|....|....|....|
NOV17a     VFTDLFGCRKTAVVGAAVGFVGLMSSSFVSSIEPLYLTYGIIFACGCSFAYQPSLVILGH    279
NOV17b     VFTDLFGCRKTAVVGAAVGFVGLMSSSFVSSIEPLYLTYGIIFACGCSFAYQPSLVILGH    193
Q91Y77     VFTDMFGCRRTAVLGAAVGFVGLMSSSFVSSIEPLYFTYGVVFACGCSFAYQPSLVIIGH    192
P36021     IFTDRLGCRITATAGAAVAFIGLHTSSFTSSLSLRYFTYGILFGCGCSFAFQPSLVILGH    296
O70324     IFTDRLGCRITATTGAAVAFIGLHTSSFTSSLSLRYFTYGILFGCGCSFAFQPSLVILDH    248
Q9P1I2     ----------------------------------------------------------      1
AAH17968   ----------------------------------------------------------      1

310       320       330       340       350       360
               ....|....|....|....|....|....|....|....|....|....|....|....|
NOV17a     YFKKRLGLVNGIVTAGSSVFTLLLPLLLRVLIDSVGLFYTLRVLCIFMFVLFLAGFTYRP    339
NOV17b     YFKKRLGLVNGIVTAGSSVFTLLLPLLLRVLIDSVGLFYTLRVLCIFMFVLFLAGFTYRP    253
Q91Y77     YFKKRLGLVNGIVTAGSSVFTLLLPLLLGNLTSVGLCYTLRILCIFMFVLFLAGFTYRP    252
P36021     YFQRRLGLANGVVSAGSSIFSMSFPFLIRMLGDIKLAQTFQVLSTFMFVLMLLSLTYRP    356
O70324     YFQRRLGLANGVVSAGSSIFSMSFPFLIKMLGDKIKLAQTFQVLSTFMFVLTLLSLTYRP    308
Q9P1I2     ----------------------------------------------------------      1
AAH17968   ----------------------------------------------------------      1

370       380       390       400       410       420
               ....|....|....|....|....|....|....|....|....|....|....|....|
NOV17a     LATSKDKESGGSGSSLFSRKKFSPPKKIFNFAIEKVTAYAVWAVGIPLALFGYFVPYVH    399
NOV17b     LATSKDKESGGSGSSLFSRKKFSPPKKIFNFAIEKVTAYAVWAVGIPLALFGYFVPYVH    313
Q91Y77     LVPSKEKESEDSRSSFFSRRKLSPPKKIFNFALEKETAYAVWAAGIPLALFGYFVPYVH    312
P36021     LLPSSQDTPSK-RGVRTLHQRFLAQLEKYFNMRVERQRTYRIWAFGIAAAALGYFVPYVH    415
O70324     LLPSSQDTPSK-RGAHTLRQRFLVQFRKYFNMRVERQRTYRIWAFGIAAAALGYFVPYVH    367
Q9P1I2     ----------------------------------------------------------      1
AAH17968   ----------------------------------------------------------      1
```

```
               430        440        450        460        470        480
            ....|....|....|....|....|....|....|....|....|....|....|....|
NOV17a      LVSMLLHKHVNERFQDEKNKEVVLMCIGVTSGVGRLLFGRIADYVPGVKKVYLQVLSFFF  459
NOV17b      LM-----KHVNERFQDEKNKEVVLMCIGVTSGVGRLLFGRIADYVPGVKKVYLQVLSFFF  368
Q91Y77      LMN----HVKERFKDVNNKEVLFMCIGVTSGVGRLLFGRIADYLPGVKKVYLQVLSFFF   367
P36021      LMK----YVEBEFSEIKETWVLVCIGATSGVGRLVSGHISDSIPGLKKIYLQVLSFLL    470
O70324      LMK----YVEDKFKEIKETWVVLVCIGATSGVGRLVSGHISDSIPGLKKIYLQVLSFLL   422
Q9P1I2      ------MKHVNERFQDEKNKEVVLMCIGVTSGVGRLLFGRIADYVPGVKKVYLQVLSFFF   54
AAH17968    ------MKHVNERFQDEKNKEVVLMCIGVTSGVGRLLFGRIADYVPGVKKVYLQVLSFFF   54

490        500        510        520        530        540
            ....|....|....|....|....|....|....|....|....|....|....|....|
NOV17a      IGLMSMMIPLCSIFGALIAVCLIMGLFDGCFISIMAPIAFELVGAQDVSQAIGLLLGFMS  519
NOV17b      IGLMSMMIPLCSIFGALIAVCLIMGLFDGCFISIMAPIAFELVGAQDVSQAIGLLLGFMS  428
Q91Y77      IGLTSMMIPLCSVFGALIACLIMGLFDGCFISIMAPIAFELVGPQDASQAIGLLLGFMS   427
P36021      IGLMSMMIPLCRDFGGLIVVCLFLGLCFFITIMAPIAFELVGPMQASQAIGYLLGMMA    530
O70324      IGLMSMMIPLCRDFGGLIVVCLFLGLCDGFFITIMAPIAFELVGPMQASQAIGYLLGMMA  482
Q9P1I2      IGLMSMMIPLCSIFGALIAVCLIMGLFDGCFISIMAPIAFELVGAQDVSQAIGLLLGFMS  114
AAH17968    IGLMSMMIPLCSIFGALIAVCLIMGLFDGCFISIMAPIAFELVGAQDVSQAIGLLLGFMS  114

550        560        570        580        590        600
            ....|....|....|....|....|....|....|....|....|....|....|....|
NOV17a      IPMTVGPPIAGLLRDKLGSYDVAFYLAGVPPIIGGAVLCFIPWIHSKKQREISKTTGKEK  579
NOV17b      IPMTVGPPIAGLLRDKLGSYDVAFYLAGVPPIIGGAVLCLIPWIHSKKQREISKNTGGEK  488
Q91Y77      IPMTVGPPVAGLLHDKLGSYDLAFYLAGIPPFIGAVLFFVPLMHQRMFKKEQRDSSKDK   487
P36021      LPMIAGPPIAGLLRNCFGDYHVAFYFAGVPPIIGAVLFFVPLMHQRMFKKEQRDSSKDK   590
O70324      LPMIAGPPIAGLLRNCFGDYHVAFYFAGVPPIIGAVLFFVPLMHQRMFKKEQRDSSKDK   542
Q9P1I2      IPMTVGPPIAGLLRDKLGSYDVAFYLAGVPPIIGGAVLCFIPWIHSKKQREISKTTGKEK  174
AAH17968    IPMTVGPPIAGLLRDKLGSYDVAFYLAGVPPIIGGAVLCFIPWIHSKKQREISKTTGKEK  174

610        620
            ....|....|....|....|..
NOV17a      MEKMLENQNSLLSSSSGMFKKESDSII  606
NOV17b      MEKMLENQNSLLSSSSGMFKKESDSII  515
Q91Y77      MEKMLANQSSLLSSSSGIFKKESDSII  514
P36021      MLAPDPDPNGELLPGS--P-NPEEPI-  613
O70324      MLSHDPDPNGELLPGS--P-TPEEPI-  565
Q9P1I2      MEKMLENQNSLLSSSSGMFKKESDSII  201
AAH17968    MEKMLENQNSLLSSSSGMFKKESDSII  201
```

The presence of identifiable domains in the disclosed NOV17 protein was determined by using Pfam and then determining the Interpro number. The results are listed in Table 17H with the statistics and domain description.

such as lactate and pyruvate. These molecules can be used to treat, e.g., infantile sialic storage disease.

In addition, various NOV17 nucleic acids and polypeptides according to the invention are useful, inter alia, as

TABLE 17H

Domain Analysis of NOV17

| PSSMs Producing Significant Alignments | Score (bits) | E Value |
| --- | --- | --- |
| sugar_tr: domain 1 of 1, from 155 to 584 | −178.6 | 1.9 |

```
Trnsptr.   valvaalgGgflfGyDtgviggflalidflfrfglltssgalaelvg
           + +++ ++ +    |   +++ +++   +   +   + ++++++
NOV17      WGWLVMLAAMWCNGSVFGIQNACGVLFVSMLETFGSKDDDK------

Trnsptr.   ystvltglvvsifflGrliGslfaGklgdrfGRkksllialvlfviGall
               ++++ +   + + ++ + +++ +++ +|  +++  +++++ ++|  +
NOV17      -MVFKTAWVGSLSMGMIFFCCPIVSVFTDLFGCRKTAVVGAAVGFVGLMS Trnsptr.   sgaapgytTiGlwafyllivGRvlvGlgvGgasvlvPmYisEiAPkalR.
           + +          +++ + +   ++ +++|+  +   |  ++       ++|
NOV17      SSFVS--------SIEPLYLTYGII-FACGCSFAYQPSLVILGHYFKKRl Trnsptr.   Galgslyqlai.tiGilvAaiiglglnktnndsalnswgWRiplglqlvp
           |   ++   + +++ +++   ++ + ++ ++          |+++++ +++
NOV17      GLVNGIVTAGSsVFTILLPLLLRVLIDSVGL-----FYTLRVLCIFMFVL Trnsptr.   alllliglflflPESPRwLvekgkle.eArevLaklrgv..edvdqeiqei
             ++ + +++++  +        ++++++ + +|    ++ +++ +       +
NOV17      FLAGFTYRPLATST------KDKESgGSGSSLFS-RKKfsPPKKIFNFAI Trnsptr.   kaeleatvseekagkaswgelfrgrtrpkvrqrllmgvmlqafqQltGiN
           +  +  +                                +++ ++++
NOV17      FKVTAYA-----------------------VMAVGIPLALFG------

Trnsptr.   aifYYsptifks.............vGvsdsvasllvtiivgvvNfvfTf
            |+ +++   +    +++ +++ +    +++   ++ + +    +     +
NOV17      ---YFVPYVHLVsmllhkhvnerfqDEKNKE---VVLMCIGVTSGVRLL Trnsptr.   vaLiflvDrf.GRRpllllGaagmaicflilgasigvallllnkpkdpss
           ++    +  |   +|  ++   +  +++ ++++   +       + ++  +
NOV17      FG--RIADYVpGVKKVYLQVLSFFFIGLMSM------MIPLCSI------

Trnsptr.   kaagivaivfillfiafFalgwGpipwvilsElFPtkvRskalalataan
                 ++++ ++++      +|   ++  ++   +   |+   ++   + ++++  + +
NOV17      ----FGALIAVCLIMGLFDGCFISIMAPIAFELVGAQDVSQAIGFLLGFM Trnsptr.   wlanfiigflfpyitgaigl....alggyvflvfagllvlfilfvfff..
             +    + + ++   ++ +++ +   +    +++   ++++  ++  ++  ++    +++
NOV17      SIPMTVGPPIAGLLRDKLGSydvaFYLAGVPPLIGGAVLCFIPWIHSKkq Trnsptr.   ..vPETkGrtLEeieelf       (SEQ ID NO:231)
           +++   | |    |+++ ++
NOV17      reISKTTG--KEKMEKML       (SEQ ID NO:58)
```

Consistent with other known members of the proton-linked monocarboxylate transporter (MCTs) family of proteins, NOV17 contains a transporter domain as illustrated in Table 17H.

NOV17 nucleic acids, and the encoded polypeptides, according to the invention are useful in a variety of applications and contexts. For example, NOV17 nucleic acids and polypeptides can be used to identify proteins that are members of the MCTs family of proteins. The NOV17 nucleic acids and polypeptides can also be used to screen for molecules, which inhibit or enhance NOV17 activity or function. Specifically, the nucleic acids and polypeptides according to the invention may be used as targets for the identification of small molecules that modulate or inhibit, e.g., cellular metabolism, or transport of monocarboxylates novel members of the protein families according to the presence of domains and sequence relatedness to previously described proteins. For example, the NOV17 nucleic acids and their encoded polypeptides include structural motifs that are characteristic of proteins belonging to the MCTs family. Monocarboxylates such as lactate and pyruvate play a pivotal role in cellular physiology of most mammalian cells. Lactic acid, in particular, is produced in huge amounts as an end-product of glycolysis. Some tissues, such as white skeletal muscle, red blood cells and tumor cells, rely on this pathway to produce majority of their ATP under normal physiological conditions, while all tissues become dependent on this pathway during hypoxia or ischaemia. Two molecules of lactic acid are generated for every glucose molecule during glycolysis. Lactic acid must be transported out of the cell if high rates of glycolysis are to be maintained. Accumulation of lactic acid leads to a decrease in intracellular pH and cessation of glycolysis. Lactic acid transport is carried out by a recently identified family of proton-linked monocarboxylate transporters (MCTs) located at the plasma membrane. At least 9 MCTs (MCT 1–9)-related genes have so far been identified in mammals, each having a different tissue distribution. MCTs also mediate the transport of many other metabolically important monocarboxylates such as pyruvate, the branched-chain oxo acids derived from leucine, valine and isoleucine, and the ketone bodies acetoacetate, -hydroxybutyrate and acetate.

The NOV17 nucleic acids and polypeptides, antibodies and related compounds according to the invention will be useful in therapeutic and diagnostic applications in the mediation of cellular metabolism and transport. As such the NOV17 nucleic acids and polypeptides, antibodies and related compounds according to the invention may be used to treat, e.g., Salla disease, infantile sialic acid storage disease, cystinosis, or streptozotocin-induced diabetes.

The NOV17 nucleic acids and polypeptides are useful for detecting specific cell types. For example, expression analysis has demonstrated that a NOV17a nucleic acid is expressed in adrenal gland, bone marrow, brain—amygdala, brain—cerebellum, brain—hippocampus, brain substantia nigra, brain—thalamus, brain—whole, fetal brain, fetal kidney, fetal liver, fetal lung, heart, kidney, lymphoma—Raji, mammary gland, pancreas, pituitary gland, placenta, prostate, salivary gland, skeletal muscle, small intestine, spinal cord, spleen, stomach, testis, thyroid, trachea, and uterus. Conversely, a NOV17b nucleic acid is expressed in parathyroid gland, liver, colon, muscle, brain, placenta, vulva, testis, lung, kidney, skin, and colon adenocarcinoma.

Additional utilities for NOV17 nucleic acids and polypeptides according to the invention are disclosed herein.

NOV18

The NOV18 proteins descibed herein are novel olfactory receptor/G-protein coupled receptor (GPCR)-like proteins.

Two alternative novel NOV18 nucleic acids and polypeptides are disclosed herein, namely NOV18a and NOV18b.

NOV18a

A NOV18 variant is NOV18a (alternatively referred to herein as CG56510-01), which encodes the 1001 nucleotide sequence (SEQ ID NO:61) shown in Table 18A. An open reading frame for the mature protein was identified beginning with an ATG codon at nucleotides 37–39 and ending with a TGA codon at nucleotides 958–960. Putative untranslated regions, if any, downstream from the termination codon and upstream from the initiation codon are underlined. The start and stop codons are in bold letters.

TABLE 18A

NOV18a Nucleotide Sequence (SEQ ID NO: 61)

<u>GTGTTCCATAGATTATTTTGTCTTTTGTCTGAAGTG</u>ATGCTGAATACAACCTCAGTCACCGAATTTCTCCTCTTG
GGAGTGACAGACATTCAAGAACTGCAGCCTTTTCTCTTCGTGGTTTTCCTCACCATCTACTTCATCAGTGTGACT
GGGAATGGAGCCGTTCTGATGATTGTCATCTCCGATCCTAGACTCCATTCCCTTATGTATTTCTTCCTGGGAAAC
CTGTCCTACCTGGATATCTGTTACTCTACGGTGACACTGCCAAAAATGCTGCAGAACTTTCTCTCTACACACAAA
GCAATTTCTTTCTTGGGATGCATAAGCCAGCTTCATTTCTTCCACTTCCTGGGCAGCACGGAGTCCATGTTGTTC
GCCGTGATGGCATTTGACCTCTCTGTGGCTATCTGCAAGCCACTTCGCTACACTGTCATCATGAACCCTCAGCTC
TGTACCCAGATGGCCATCACAATCTGGGTCATTGGTTTTTTCCATGCCCTGCTGCACTCCGTAATGACTTCTCGC
TTGAACTTCTGTGGTTCCAACCGTATCCATCATTTTCTCTGTGATATTAAGCCATTGCTAAAGCTGGCCTGTGGG
AACACTGAGCTTAATCAGTGGCTACTCAGTACTGTCACGGGGACAATTGCCATGGGCCCCTTCTTTCTGACACTT
CTCTCCTATTTCTACATTATCACTTATCTCTTCTTCAAGACCCGTTCTTGTAGCATGCTCTGTAAAGCACTGTCC
ACTTGTGCCTCCCACTTCATGGTAGTTATTCTTTTCTATGCACCTGTTCTTTTCACCTATATCCATCCTGCGTTA
GAGAGCTTCATGGACCAGGACCGGATTGTTGCCATCATGTACACTGTGGTCACTCCTGTACTAAACCCACTGATC
TATACTTTGAGGAACAAGGAAGTGAAGGGGGCCTTGGGTAGAGTGATCAGAAGGCTTTGA<u>TTTGAATAAACCAGA
GAACTCTACTGAGGCATAAATAACCA</u>

The NOV18a protein (SEQ ID NO:62) encoded by SEQ ID NO:61 is 307 amino acid residues in length and is presented using the one-letter amino acid code in Table 18B. The SignalP, Psort and/or Hydropathy results indicate that NOV18a has a signal peptide and is likely to be localized at the plasma membrane with a certainty of 0.6000. Alternatively, a NOV18a polypeptide is located in the Golgi body with a certainty of 0.4000, the endoplasmic reticulum (membrane) with a certainty of 0.3000, or the microbody (peroxisome) with a certainty of 0.3000. The SignalP indicates a likely cleavage site for a NOV18a peptide between positions 39 and 40, i.e., at the dash in the sequence VTG-NG.

TABLE 18B

Encoded NOV18a Protein Sequence (SEQ ID NO: 62)

MLNTTSVTEFLLLGVTDIQELQPFLFVVFLTIYFISVTGNGAVLMIVISDPRLHSLMYFFLGNLSYLDICYSTVT
LPKMLQNFLSTHKAISFLGCISQLHFFHFLGSTESMLFAVMAFDLSVAICKPLRYTVIMNPQLCTQMAITIWVIG
FFHALLHSVMTSRLNFCGSNRIHHFLCDIKPLLKLACGNTELNQWLLSTVTGTIAMGPFFLTLLSYFYIITYLFF
KTRSCSMLCKALSTCASHFMVVILFYAPVLFTYIHPALESFMDQDRIVAIMYTVVTPVLNPLIYTLRNKEVKGAL
GRVIRRL

SNP variants of NOV18a are disclosed in Example 2.

NOV18b

Alternatively, a NOV18 variant is NOV18b (alternatively referred to herein as CG56510-02), which includes the 1101 nucleotide sequence (SEQ ID NO:63) shown in Table 18C. An open reading frame for the mature protein was identified beginning with an ATG codon at nucleotides 148–150 and ending with a TGA codon at nucleotides 1069–1071. Putative untranslated regions, if any, downstream from the termination codon and upstream from the initiation codon are underlined. The start and stop codons are in bold letters.

TABLE 18C

NOV18b Nucleotide Sequence (SEQ ID NO: 63)

TAAGCTTCTATACAACTTCTGAGGTTTGGAAGAAGTACAACAGTACTCTCCTTCCAAGTATCTTTGGCTTGGTGA
GAAAATTCTGAGCCGGAAGGATTCTGATTGCGATTAGTGTTCCATAGATTATTTTGTCTTTTGTCTGAAGTGATG
CTGAATACAACCTCAGTCACCGAATTTCTCCTCTTGGGAGTGACAGACATTCAAGAACTGCAGCCTTTTCTCTTC
GTGGTTTTCCTCACCATCTACTTCATCAGTGTGACTGGGAATGGAGCCGTTCTGATGATTGTCATCTCCGATCCT
AGACTCCATTCCCTTATGTATTTCTTCCTGGGAAACCTGTCCTACCTGGATATCTGTTACTCTACGGTGACACTG
CCAAAAATGCTGCAGAACTTTCTCTCTACACACAAAGCAATTTCTTTCTTGGGATGCATAAGCCAGCTTCATTTC
TTCCACTTCCTGGGCAGCACGGAGTCCATGTTGTTCGCCGTGATGGCATTTGACCTCTCTGTGGCTATCTGCAAG
CCACTTCGCTACACTGTCATCATGAACCCTCAGCTCTGTACCCAGATGGCCATCACAATCTGGGTCATTGGTTTT
TTCCATGCCCTGCTGCACTCCGTAATGACTTCTCGCTTGAACTTCTGTGGTTCCAACCGTATCCATCATTTTCTC
TGTGATATTAAGCCATTGCTAAAGCTGGCCTGTGGGAACACTGAGCTTAATCAGTGGCTACTCAGTACTGTCACG
GGGACAATTGCCATGGGCCCCTTCTTTCTGACACTTCTCTCCTATTTCTACATTATCACTTATCTCTTCTTCAAG
ACCCGTTCTTGTAGCATGCTCTGTAAAGCACTGTCCACTTGTGCCTCCCACTTCATGGTAGTTATTCTTTTCTAT
GCACCTGTTCTTTTCACCTATATCCATCCTGCGTTAGAGAGCTTCATGGACCAGGACCGGATTGTGCCATCATG
TACACTGTGGTCACTCCTGTACTAAACCCACTGATCTATACTTTGAGGAACAAGGAAGTGAAGGGGGCCTTGGGT
AGAGTGATCAGAAGGCTTGATTTGAATAAACCAGAGAACTCTACTGAGGC

The NOV18b nucleic acid (SEQ ID NO:63) encodes the NOV18a protein SEQ ID NO:62.

NOV18 Clones

Unless specifically addressed as NOV18a or NOV18b, any reference to NOV18 is assumed to encompass all variants.

A search against the Patp database, a proprietary database that contains sequences published in patents and patent publication, yielded several homologous proteins shown in Table 18D.

TABLE 18D

PatP Results for NOV18

| Sequences Producing High-Scoring Segment Pairs: | High Score | Smallest Sum Prob P (N) |
|---|---|---|
| patp: AAG72203 Human olfactory receptor polypeptide | 1590 | 4.0e-163 |
| patp: AAG72870 Human olfactory receptor data exploratorium sequence | 1590 | 4.0e-163 |
| patp: AAG71661 Human olfactory receptor polypeptide | 1344 | 4.7e-137 |
| patp: AAG72212 Human olfactory receptor polypeptide | 1344 | 4.7e-137 |
| patp: AAG72633 Murine OR-like polypetide query sequence | 1296 | 5.7e-132 |

In a BLAST search of public sequence databases, it was found, for example, that the NOV18 nucleic acid sequences of this invention have 590 of 911 bases (64%) identical to a gb:GENBANK-ID:AF101730|acc:AF101730.1 mRNA from Pan troglodytes isolate PTOR1E1 olfactory receptor gene, complete cds. Further, the full amino acid sequence of the disclosed NOV18 protein of the invention has 205 of 306 amino acid residues (66%) identical to, and 251 of 306 amino acid residues (82%) similar to, the 316 amino acid residue ptnr:SPTREMBL-ACC:Q9UGF7 protein from Human (BA150A6.1 (NOVEL 7 TRANSMEMBRANE RECEPTOR(RHODOPSIN FAMILY) (OLFACTORY RECEPTOR LIKE) PROTEIN (HS6M1-27))). While it has not been annotated as an olfactory receptor, genomic clone Genbank ID AL049739.2 shows 100% homology to NOV18.

Additional BLAST results are shown in Table 18E.

TABLE 18E

NOV18 BLASTP Results

| Gene Index/Identifier | Protein/Organism | Length of aa | Identity (%) | Positives (%) | Expect Value |
|---|---|---|---|---|---|
| P58182 | Olfactory receptor 12D2 (Hs6M1-20) - Homo sapiens (Human) | 307 | 307/307 (100%) | 307/307 (100%) | 5.1e-163 |
| Q920Y9 | BM332P19.2 (NOVEL 7 TRANSMEMBRANE RECEPTOR (RHODOPSIN FAMILY) (OLFACTORY RECEPTOR LIKE) PROTEIN (MM17M1-13), ORTHOLOG OF HUMAN DJ994E9.8 (HS6M1-20)) - Mus musculus (Mouse) | 308 | 245/306 (80%) | 268/306 (87%) | 7.3e-132 |

TABLE 18E-continued

NOV18 BLASTP Results

| Gene Index/Identifier | Protein/Organism | Length of aa | Identity (%) | Positives (%) | Expect Value |
|---|---|---|---|---|---|
| Q920Y8 | BM332P19.3 (NOVEL 7 TRANSMEMBRANE RECEPTOR (RHODOPSIN FAMILY) (OLFACTORY RECEPTOR LIKE) PROTEIN (MM17M1-14)) - *Mus musculus* (Mouse) | 313 | 240/306 (78%) | 267/306 (87%) | 8.7e-129 |
| Q920Z0 | BM332P19.1 (NOVEL 7 TRANSMEMBRANE RECEPTOR (RHODOPSIN FAMILY) (OLFACTORY RECEPTOR LIKE) PROTEIN (MM17M1-12)) - *Mus musculus* (Mouse) | 308 | 240/306 (78%) | 263/306 (85%) | 9.9e-128 |
| CAC44547 | BM332P19.4 (NOVEL 7 TRANSMEMBRANE RECEPTOR (RHODOPSIN FAMILY) (OLFACTORY RECEPTOR LIKE) PROTEIN (MM17M1-8P)) - *Mus musculus* (Mouse) | 277 | 206/276 (74%) | 243/276 (88%) | 2.6e-113 |

A multiple sequence alignment is given in Table 18F, with the NOV18 protein of the invention being shown in line 1 in a ClustalW analysis comparing NOV18 with related protein sequences of Table 18E.

Table 18F. ClustalW Analysis of NOV18

1. SEQ ID NO.: 62   NOV18
2. SEQ ID NO.: 232  P58182
3. SEQ ID NO.: 233  Q920Y9
4. SEQ ID NO.: 234  Q920Y8
5. SEQ ID NO.: 235  Q920Z0
6. SEQ ID NO.: 236  CAC44547

```
              10        20        30        40        50        60
              ....|....|....|....|....|....|....|....|....|....|....|....|
NOV18     MLNTTSVTEFLLLGVTDIQELQPFLFVVFLTIYFLSVTGNGAVLMIVISDPRLHSLMYFF  60
P58182    MLNTTSVTEFLLLGVTDIQELQPFLFVVFLTIYFLSVTGNGAVLMIVISDPRLHSLMYFF  60
Q920Y9    MSNQTSVTEFLLLGVTDIQELNPILFVFFTIYFVNLTGNGAILMIVILDPRLHSPMYFF  60
Q920Y8    MLNQTSVTEFLLLGVRDIQEPQPFLFAFFTIYFVNLTGNGAILMIVILDPRLHSPMYFF  60
Q920Z0    MSNQTSVTEFLLLGVTDIQELNPILFVFFTIYFINLTGNGAILMIVILDPRLHSPMYFF  60
CAC44547  -----------------------------MYFVNVAGNGAILMIVISDPRLHLPMYFF  29

70        80        90       100       110       120
              ....|....|....|....|....|....|....|....|....|....|....|....|
NOV18     LGNLSYLDICYSTVTLPKMLQNFLSTLKAISFLGCISQLHFFHFLGSTESMLFAVMAFDL 120
P58182    LGNLSYLDICYSTVTLPKMLQNFLSTLKAISFLGCISQLHFFHFLGSTESMLFAVMAFDL 120
Q920Y9    LGNLACLDICFSTVTLPKMLQNLLSTNKAISFLGCITQLHFFHFLGSTEAMLLPVMAFDR 120
Q920Y8    LGNLACLDISYSTVTLPKMLENLLSTNKAISLLGCITQLHFFHFLGTTESLLAVMAFDR 120
Q920Z0    LGNLACLDISYSTVTLPKLLQNLLSTSKAISFLGCITQLHFFHFLGSTEMLLPVMAFDR 120
CAC44547  LGNLACLDICFSTVTVPKMLENFFSTSKAISFLGCITQLHFFNFLGSTEALLLTVMAFDR  89

130       140       150       160       170       180
              ....|....|....|....|....|....|....|....|....|....|....|....|
NOV18     SVAICKPLRYVIMNPQLCTQMALTIWVIGFFHALLHSVMTSRLNFCGSNRIHHFLCDIK 180
P58182    SVAICKPLRYVIMNPQLCTQMALTIWVIGFFHALLHSVMTSRLNFCGSNRIHHFLCDIK 180
Q920Y9    FVAICRPLHYSVIMNHQLCIHMTVTIWTLGFFHALLHSVMTSRLSFCGPNHVHHFFCDIK 180
Q920Y8    FVAICRPLHYSVIMNWQVCILMAVTIWTIAFLHALLHSVMTSRLSFCGLNHIHHFFCDVK 180
Q920Z0    FVAICRPLHYSVIMNHQLCIHMTVTIWTLGFFHALLHSVMTSRLSFCGPNHVHHFFCDIK 180
CAC44547  FVAICRPLHYPAIMNSQVCIQVALSIWAIPFLHALVHSLLTSQLNFCGSNHIHHFFCDVK 149

190       200       210       220       230       240
              ....|....|....|....|....|....|....|....|....|....|....|....|
NOV18     PLLKLACGNTELNQWLLSTVTGTIAMGPFFLTLLSYFYIITYLFFKTRSCSMLCKALSTC 240
P58182    PLLKLACGNTELNQWLLSTVTGTIAMGPFFLTLLSYFYIITYLFFKTRSCSMLCKALSTC 240
Q920Y9    PLLDLACGNTELNLWLLNTVTGTIALTPFFLTFLSYFYIITYLFLKTRSCSMLHKALSTC 240
Q920Y8    PLLELACGNTELNLWLLNTVTGTIASVPFFLTFLSYFYIITYLFLKTRSCSMLHKALSTC 240
Q920Z0    PLLDLACGNTELNLWLLNTVTGTIATSFFLIFLSYFYIITNLLLKTRSCSMLHKALSTC 240
CAC44547  PLLELACGNTELNRWLLNTLTGTVAIGLFFLTFLSYFYIVTYLFLKTRSCSMLHKALSTC 209

250       260       270       280       290       300
              ....|....|....|....|....|....|....|....|....|....|....|....|
NOV18     ASHFMVVLLFYAPVLFTYIHPALESFMDQDRIVAIMYVVVTPVLNPLIYTLRNKEVKGAL 300
P58182    ASHFMVVLLFYAPVLFTYIHPALESFMDQDRIVAIMYVVVTPVLNPLIYTLRNKEVKGAL 300
```

```
Q920Y9    ASHFMVVILLYVPVLFTYIRPASGSSLDQDRIIAIMYSVVTPALNPLIYTLRNKEVRSAL  300
Q920Y8    ASHFMVVLFYAPVLFTYIRPTSGSSLDQDRIIAIMYSVVTPALNPLIYTLRNKEVRSAL   300
Q920Z0    ASHFMVVLFYAPVLFTYIRPASGSSLDQDTIIAIMYSVVTPALNPLIYTLRNKEVRSAL   300
CAC44547  ASHFMVVLFYAPVLFIYINPDSGSSLEKDRIIAVMYIVVTPALNPLIYTLRNKEVRGAL   269

310
           ....|....|...
NOV18     GRVIRRL------ 307
P58182    GRVIRRL------ 307
Q920Y9    NRKVRRWL----- 308
Q920Y8    NRKVRRCLLLEEI 313
Q920Z0    NRKVRRWL----- 308
CAC44547  NRKIRILL----- 277
```

The presence of identifiable domains in the disclosed NOV18 protein was determined by using Pfam and then determining the Interpro number. The results are listed in Table 18G with the statistics and domain description.

separated by hydrophilic segments that project into the intra- or extra-cellular space. Transmembrane domains II–VII comprise a hypervariable segment that defines the ligand specificity of the receptor.

TABLE 18G

Domain Analysis of NOV18

| PSSMs Producing Significant Alignments | Score (bits) | E Value |
|---|---|---|
| 7tm_1: domain 1 of 1, from 39 to 289 | 68.8 | 5.6e-21 |

```
7tm      GNlLVilvilrtkklrtptnifilNLAvADLLflltlppwalyylvg
         ||+ |+++++    ++++ ++++++||+  |++++++ ++ ++ +++
NOV18    GNGAVLMIVISDPRLHSLMYFFLGNLSYLDICYSTVTLPKMLQNFLS 7tm      gsedWpfGsalCklvtaldvvnmyaSillLtaISiDRYlAIvhPlryrrr
         ++ ++ ++|  +  ++ + + +  ++ +++++|  +||++|+++ ++
NOV18    --THKAISFLGCISQLHFFHFLGSTESMLFAVMAFDLSVAICKPLRYTVI 7tm      rtsprrAkvvillvWvlalllslPpllfswvktveegngtlnvnvtvCli
         ++ ++++  + + +|++++  ++++ ++ ++++++++++   + ++ |++
NOV18    MN-PQLCTQMAITIWVIGFFHALLHSVM-TSRLNFCGSNR--IHHFLCDI 7tm      dfpeestasvstwlrsyvllstlvgFllPllvilvcYtrIlrtlr.....
            +++  +   ++     +    + |+++ +  |+ |+  ++ ++++
NOV18    KPLLKLACGNTELNQWLLSTVTGTIAMGPFFLTLLSYFYIITYLFfktrs 7tm      .....kaaktllvvvvvFvlCWlPyfivllldtlc.lsiimsstCelerv
         +   +++ + +     +++++ +|   + +  ++ ++
NOV18    csmlcKALSTCASHFMVVILFYAPVLFTYIHPALEsFM------------

7tm      lptallvtlwLayvNsclNPiIY       (SEQ ID NO:237)
         +    +++++++++ +++||+||
NOV18    -DQDRIVAIMYTVVTPVLNPLIY       (SEQ ID NO:62)
```

Consistent with other known members of the olfactory receptor family of proteins, NOV18 contains 7-transmembrane domains as illustrated in Table 18G.

The NOV18 nucleic acids, and the encoded polypeptide, according to the invention are useful in a variety of applications and contexts. For example, NOV18 nucleic acids and polypeptides can be used to identify proteins that are members of the olfactory receptor family of proteins. The NOV18 nucleic acids and polypeptides can also be used to screen for molecules, which inhibit or enhance NOV18 activity or function. Specifically, the nucleic acids and polypeptides according to the invention may be used as targets for the identification of small molecules that modulate or inhibit, e.g., cellular recognition, or G-protein-mediated transduction of odorant signals. These molecules can be used to treat, e.g., taste and scent detectability disorders, immune diseases, or signal transduction pathways.

In addition, the NOV18 nucleic acids and polypeptide according to the invention are useful, inter alia, as novel members of the protein families according to the presence of domains and sequence relatedness to previously described proteins. For example, the NOV18 nucleic acids and polypeptide include structural motifs that are characteristic of proteins belonging to the family of olfactory receptor proteins. Olfactory receptors have great variety, exquisite specificity, high sensitivity and fast response. The human olfactory epithelium contains two to three thousand distinct olfactory receptors, a class of G-protein coupled receptors. The receptors consist of seven hydrophobic segments that span the cell membrane (trans-membrane domains I–VII), The NOV18 nucleic acids and polypeptide, antibodies and related compounds according to the invention will be useful in therapeutic and diagnostic applications in the mediation of signal transduction. As such the NOV18 nucleic acids and polypeptide, antibodies and related compounds according to the invention may be used to treat, e.g., developmental diseases, MHC II and III diseases (immune diseases), taste and scent detectability disorders, Burkitt's lymphoma, corticoneurogenic disease, signal transduction pathway disorders, retinal diseases including those involving photoreception, cell growth rate disorders, cell shape disorders, feeding disorders, control of feeding, potential obesity due to over-eating, potential disorders due to starvation (lack of apetite), noninsulin-dependent diabetes mellitus (NIDDM1), bacterial, fungal, protozoal and viral infections (particularly infections caused by HIV-1 or HIV-2), pain, cancer (including but not limited to neoplasm, adenocarcinoma, lymphoma, prostate cancer, uterus cancer), anorexia, bulimia, asthma, parkinson's disease, acute heart failure, hypotension, hypertension, urinary retention, osteoporosis, crohn's disease, multiple sclerosis, and treatment of albright hereditary ostoeodystrophy, angina pectoris, myocardial infarction, ulcers, asthma, allergies, benign prostatic hypertrophy, and psychotic and neurological disorders, including anxiety, schizophrenia, manic depression, delirium, dementia, severe mental retardation, dentatorubropallidoluysian atrophy(DRPLA) hypophosphatemic rickets, autosomal dominant (2) acrocallosal syndrome and dyskinesias, such as huntington's disease or gilles de la tourette syndrome.

The NOV18 nucleic acids and polypeptide are useful for detecting specific cell types. For example, expression analysis has demonstrated that a NOV18 nucleic acid is predominantly expressed in olfactory epithelium and taste receptor cells of the tongue. However, it is also expressed in apical microvilli of the retinal pigment epithelium, arterial (aortic), basal forebrain, brain, Burkitt lymphoma cell lines, corpus callosum, cardiac (atria and ventricle), caudate nucleus, CNS and peripheral tissue, cerebellum, cerebral cortex, colon, cortical neurogenic cells, endothelial (coronary artery and umbilical vein) cells, palate epithelia, eye, neonatal eye, frontal cortex, fetal hematopoietic cells, heart, hippocampus, hypothalamus, leukocytes, liver, fetal liver, lung, lung lymphoma cell lines, fetal lymphoid tissue, adult lymphoid tissue, those that express MHC II and III nervous, medulla, subthalamic nucleus, ovary, pancreas, pituitary, placenta, pons, prostate, putamen, serum, skeletal muscle, small intestine, smooth muscle (coronary artery in aortic) spinal cord, spleen, stomach, testis, thalamus, and thymus tissue.

Additional utilities for the NOV18 nucleic acid and polypeptide according to the invention are disclosed herein.

NOV19

A NOV19 polypeptide has been identified as a Major Duchenne Muscular Dystrophy (DP71)-like protein. The novel NOV19 nucleic acid sequences maps to the chromosome Xp21.2. Two alternative novel NOV19, NOV19a and NOV19b, nucleic acids and encoded polypeptides are provided.

NOV19a

A NOV19 variant is the novel NOV19a (alternatively referred to herein as CG56574-01), which includes the 2463 nucleotide sequence (SEQ ID NO:64) shown in Table 19A. A NOV19a ORF begins with a TGG initiation codon at nucleotides 3–5 and ends with a TAA codon at nucleotides 2106–2108. Putative untranslated regions upstream from the initiation codon and downstream from the termination codon are underlined in Table 19A, and the start and stop codons are in bold letters.

TABLE 19A

NOV19a Nucleotide Sequence (SEQ ID NO: 64)

<u>GG</u>TGGGCGAGCCGACACACGCCCGCCCCGTCTGGGGGCAGCGCCCCCTCCCCGGCCCGCCCGCGCCG
GCTCCTCCGCAGTGCTTTCAGCTGTGAGCTTGGGCGGCGGCGGCGGCGGCGCTCCACTTTCGGGGAG
CCCGGCGGCTCTGGGAAGCTCACTCCTCCACTCGTACCCACACTCGACCGCGGAGCCCTTGCAGCCA
TGAGGGAACAGCTCAAAGGCCACGAGACTCAAACAACTTGCTGGGACCATCCCAAAATGACAGAGCT
CTACCAGTCTTTAGCTGACCTGAATAATGTCAGATTCTCAGCTTATAGGACTGCCATGAAACTCCGA
AGACTGCAGAAGGCCCTTTGCTGGGATCTCTTGAGCCTGTCAGCTGCATGTGATGCCTTGGACCAGC
ACAACCTCAAGCAAAATGACCAGCCCATGGATATCCTGCAGATTATTAATTGTTTGACCACTATTTA
TGACCGCCTGGAGCAAGAGCACAACAATTTGGTCAACGTCCCTCTCTGCGTGGATATGTGTCTGAAC
TGGCTGCTGAATGTTTATGATACGGGACGAACAGGGAGGATCCGTGTCCTGTCTTTTAAAACTGGCA
TCATTTCCCTGTGTAAAGCACATTTGGAAGACAAGTACAGAAACCTTTTCAAGCAAGTGGCAAGTTC
AACAGGATTTTGTGACCAGCGCAGGCTGGGCCTCCTTCTGCATGATTCTATCCAAATTCCAAGACAG
TTGGGTGAAGTTGCATCCTTTGGGGGCAGTAACATTGAGCCAAGTGTCCGGAGCTGCTTCCAATTTG
CTAATAATAAGCCAGAGATCGAAGCGGCCCTCTTCCTAGACTGGATGAGACTGGAACCCCAGTCCAT
GGTGTGGCTGCCCGTCCTGCACAGAGTGGCTGCTGCAGAAACTGCCAAGCATCAGGCCAAATGTAAC
ATCTGCAAAGAGTGTCCAATCATTGGATTCAGGTACAGGAGTCTAAAGCACTTTAATTATGACATCT
GCCAAAGCTGCTTTTTTTCTGGTCGAGTTGCAAAAGGCCATAAAATGCACTATCCCATGGTGGAATA
TTGCACTCCGACTACATCAGGAGAAGATGTTCGAGACTTTGCCAAGGTACTAAAAAACAAATTTCGA
ACCAAAAGGTATTTTGCGAAGCATCCCCGAATGGGCTACCTGCCAGTGCAGACTGTCTTAGAGGGGG
ACAACATGGAAACTCCCGTTACTCTGATCAACTTCTGGCCAGTAGATTCTGCGCCTGCCTCGTCCCC
TCAGCTTTCACACGATGATACTCATTCACGCATTGAACATTATGCTAGCAGGCTAGCAGAAATGGAA
AACAGCAATGGATCTTATCTAAATGATAGCATCTCTCCTAATGAGAGCATAGATGATGAACATTTGT
TAATCCAGCATTACTGCCAAAGTTTGAACCAGGACTCCCCCCTGAGCCAGCCTCGTAGTCCTGCCCA
GATCTTGATTTCCTTAGAGAGTGAGGAAAGAGGGGAGCTAGAGAGAATCCTAGCAGATCTTGAGGAA
GAAAACAGGAATCTGCAAGCAGAATATGACCGTCTAAAGCAGCAGCACGAACATAAAGGCCTGTCCC
CACTGCCGTCCCCTCCTGAAATGATGCCCACCTCTCCCCAGAGTCCCCGGGATGCTGAGCTCATTGC
TGAGGCCAAGCTACTGCGTCAACACAAAGGCCGCCTGGAAGCCAGGATGCAAATCCTGGAAGACCAC
AATAAACAGCTGGAGTCACAGTTACACAGGCTAAGGCAGCTGCTGGAGCAACCCAGGCAGAGGCCA
AAGTGAATGGCACAACGGTGTCCTCTCCTTCTACCTCTCTACAGAGGTCCGACAGCAGTCAGCCTAT
GCTGCTCCGAGTGGTTGGCAGTCAAACTTCGGACTCCATGGGTGAGGAAGATCTTCTCAGTCCTCCC
CAGGACACAAGCACAGGGTTAGAGGAGGTGATGGAGCAACTCAACAACTCCTTCCCTAGTTCAAGAG
GACACAATGTAGGAAGTCTTTTCCACATGGCAGATGATTTGGGCAGAGCGATGGAGTCCTTAGTATC
AGTCATGACAGATGAAGAAGGAGCAGAATAA<u>ATGTTTTACAACTCCTGATTCCCGCATGGTTTTTAT
AATATTCATACAACAAAGAGGATTAGACAGTAAGAGTTTACAAGAAATAAATCTATATTTTTGTGAA
GGGTAGTGGTATTATACTGTAGATTTCAGTAGTTTCTAAGTCTGTTATTGTTTTGTTAACAATGGCA
GGTTTTACACGTCTATGCAATTGTACAAAAAAGTTATAAGAAAACTACATGTAAAATCTTGATAGCT
AAATAACTTGCCATTTCTTTATATGGAACGCATTTTGGGTTGTTTAAAAATTTATAACAGTTATAAA
GAAAGATTGTAAACTAAAGTGTGCTTTATAAAAAAAGTTGTTTATAAAAAC</u>

The NOV19a polypeptide (SEQ ID NO:65) encoded by SEQ ID NO:64 is 701 amino acid residues in length and is presented using the one-letter amino acid code in Table 19B. The Psort profile for the NOV19a predicts that this peptide is likely to be localized at the nucleus with a certainty of 0.9700.

TABLE 19B

NOV19a protein sequence (SEQ ID NO: 65)

WASRHTPAPSGGSAPSPARPRRLLRSAFSCELGRRRRRRSTFGEPGGSGKLTPPLVPTLDRGALAAM
REQLKGHETQTTCWDHPKMTELYQSLADLNNVRFSAYRTAMKLRRLQKALCWDLLSLSAACDALDQH
NLKQNDQPMDILQIINCLTTIYDRLEQEHNNLVNVPLCVDMCLNWLLNVYDTGRTGRIRVLSFKTGI
ISLCKAHLEDKYRNLFKQVASSTGFCDQRRLGLLLHDSIQIPRQLGEVASFGGSNIEPSVRSCFQFA
NNKPEIEAALFLDWMRLEPQSMVWLPVLHRVAAAETAKHQAKCNICKECPIIGFRYRSLKHFNYDIC
QSCFFSGRVAKGHKMHYPMVEYCTPTTSGEDVRDFAKVLKNKFRTKRYFAKHPRMGYLPVQTVLEGD
NMETPVTLINFWPVDSAPASSPQLSHDDTHSRIEHYASRLAEMENSNGSYLNDSISPNESIDDEHLL
IQHYCQSLNQDSPLSQPRSPAQILISLESEERGELERILADLEEENRNLQAEYDRLKQQHEHKGLSP
LPSPPEMMPTSPQSPRDAELIAEAKLLRQHKGRLEARMQILEDHNKQLESQLHRLRQLLEQPQAEAK
VNGTTVSSPSTSLQRSDSSQPMLLRVVGSQTSDSMGEEDLLSPPQDTSTGLEEVMEQLNNSFPSSRG
HNVGSLFHMADDLGRAMESLVSVMTDEEGAE

NOV19b

Alternatively, a NOV19 variant is the novel NOV19b (alternatively referred to herein as CG56574-02), which includes the 2005 nucleotide sequence (SEQ ID NO:66) shown in Table 19C. NOV19b was created by polymerase chain reaction (PCR) using the primers: 5'GAAGCT-CACTCCTCCACTCGTACC 3' (SEQ ID NO:237) and 5'ATGAATATTATAAAAACCATGCGGGAA 3' (SEQ ID NO:238). Primers were designed based on in silico predictions of the full length or some portion (one or more exons) of the cDNA/protein sequence of the invention. The PCR product derived by exon linking, covering the entire open reading frame, was cloned into the pCR2.1 vector from Invitrogen to provide clone 127720::M_18533r3_0_0.698587.P22.

The NOV19b ORF begins with a Kozak consensus ATG initiation codon at nucleotides 53–55 and ends with a TAA codon at nucleotides 1958–1960. Putative untranslated regions upstream from the initiation codon and downstream from the termination codon are underlined in Table 19C, and the start and stop codons are in bold letters.

TABLE 19C

NOV19b Nucleotide Sequence (SEQ ID NO: 66)

GAAGCTCACTCCTCCACTCGTACCCACACTCGACCGCGGAGCCCTTGCAGCCATGAGGGAACAGCTC
AAAGGCCACGAGACTCAAACAACTTGCTGGGACCATCCCAAAATGACAGAGCTCTACCAGTCTTTAG
CTGACCTGAATAATGTCAGATTCTCAGCTTATAGGACTGCCATGAAACTCCGAAGACTGCAGAAGGC
CCTTTGCTTGGATCTCTTGAGCCTGTCAGCTGCATGTGATGCCTTGGACCAGCACAACCTCAAGCAA
AATGACCAGCCCATGGATATCCTGCAGATTATTAATTGTTTGACCACTATTTATGACCGCCTGGAGC
AAGAGCACAACAATTTGGTCAACGTCCCTCTCTGCGTGGATATGTGTCTGAACTGGCTGCTGAATGT
TTATGATACGGGACGAACAGGGAGGATCCGTGTCCTGTCTTTTAAAACTGGCATCATTTCCCTGTGT
AAAGCACATTTGGAAGACAAGTACAGATACCTTTTCAAGCAAGTGGCAAGTTCAACAGGATTTTGTG
ACCAGCGCAGGCTGGGCCTCCTTCTGCATGATTCTATCCAAATTCCAAGACAGTTGGGTGAAGTTGC
ATCCTTTGGGGGCGGTAACATTGAGCCAAGTGTCCGGAGCTGCTTCCAATTTGCTAATAATAAGCCA
GAGATCGAAGCGGCCCTCTTCCTAGACTGGATGAGACTGGAACCCCAGTCCATGGTGTGGCTGCCCG
TCCTGCACAGAGTGGCTGCTGCAGAAACTGCCAAGCATCAGGCCAAATGTAACATCTGCAAAGAGTG
TCCAATCATTGGATTCAGGTACAGGAGTCTAAAGCACTTTAATTATGACATCTGCCAAAGCTGCTTT
TTTTCTGGTCGAGTTGCAAAAGGCCATAAAATGCACTATCCCATGGTGGAATATTGCACTCCGACTA
CATCAGGAGAAGATGTTCGAGACTTTGCCAAGGTACTAAAAAACAAATTTCGAACCAAAAGGTATTT
TGCGAAGCATCCCCGAATGGGCTACCTGCCAGTGCAGACTGTCTTAGAGGGGGACAACATGGAAACT
CCCGTTACTCTGATCAACTTCTGGCCAGTAGATTCTGCGCCTGCCTCGTCCCCTCAGCTTTCACACG
ATGATACTCATTCACGCATTGAACATTATGCTAGCAGGCTAGCAGAAATGGAAAACAGCAATGGATC
TTATCTAAATGATAGCATCTCTCCTAATGAGAGCATAGATGATGAACATTTGTTAATCCAGCATTAC
TGCCAAAGTTTGAACCAGGACTCCCCCCTGAGCCAGCCTCGTAGTCCTGCCCAGATCTTGATTTCCT
TAGAGAGTGAGGAAAGAGGGGAGCTAGAGAGAATCCTAGCAGATCTTGAGGAAGAAAACAGGAATCT
GCAAGCAGAATATGACCGTCTAAAGCAGCAGCACGAACATAAAGGCCTGTCCCCACTGCCGTCCCCT
CCTGAAATGATGCCCACCTCTCCCCAGAGTCCCCGGGATGCTGAGCTCATTGCTGAGGCCAAGCTAC
TGCGTCAACACAAAGGCCGCCTGGAAGCCAGGATGCAAATCCTGGAAGACCACAATAAACAGCTGGA
GTCACAGTTACACAGGCTAAGGCAGCTGCTGGAGCAACCCCAGGCAGAGGCCAAAGTGAATGGCGCA
ACGGTGTCCTCTCCTTCTACCTCTCTACAGAGGTCCGACAGCAGTCAGCCTATGCTGCTCCGAGTGG
TTGGCAGTCAAACTTCGGACTCCATGGGTGAGGAAGATCTTCTCAGTCCTCCCCAGGACACAAGCAC
AGGGTTAGAGGAGGTGATGGAGCAACTCAACAACTCCTTCCCTAGTTCAAGAGGACACAATGTAGGA
AGTCTTTTCCACATGGCAGATGATTTGGGCAGAGCGATGGAGTCCTTAGTATCAGTCATGACAGATG
AAGAAGGAGCAGAATAAATGTTTTACAACTCCTGATTCCCGCATGGTTTTTATAATATTCAT

Variant sequences of NOV19b are included in Example 2. A variant sequence can include a single nucleotide polymorphism (SNP). A SNP can, in some instances, be referred to as a "cSNP" to denote that the nucleotide sequence containing the SNP originates as a cDNA.

The NOV19b protein (SEQ ID NO:67) encoded by SEQ ID NO:66 is 635 amino acid residues in length and is presented using the one-letter code in Table 19D. The Psort profile for NOV19b predicts that this sequence is likely to be localized at the cytoplasm with a certainty of 0.4500. The Signal P predicts a likely cleavage site for a NOV19b peptide is between positions 64 and 65, i.e., at the dash in the sequence CDA-LD.

TABLE 19D

NOV19b protein sequence (SEQ ID NO: 67)

MREQLKGHETQTTCWDHPKMTELYQSLADLNNVRFSAYRTAMKLRRLQKALCLDLLSLSAACDALDQ
HNLKQNDQPMDILQIINCLTTIYDRLEQEHNNLVNVPLCVDMCLNWLLNVYDTGRTGRIRVLSFKTG
IISLCKAHLEDKYRYLFKQVASSTGFCDQRRLGLLLHDSIQIPRQLGEVASFGGGNIEPSVRSCFQF
ANNKPEIEAALFLDWMRLEPQSMVWLPVLHRVAAAETAKHQAKCNICKECPIIGFRYRSLKHFNYDI
CQSCFFSGRVAKGHKMHYPMVEYCTPTTSGEDVRDFAKVLKNKFRTKRYFAKHPRMGLYPVQTVLEG
DNMETPVTLINFWPVDSAPASSPQLSHDDTHSRIEHYASRLAEMENSNGSYLNDSISPNESIDDEHL
LIQHYCQSLNQDSPLSQPRSPAQILISLESEERGELERILADLEEENRNLQAEYDRLKQQHEHKGLS
PLPSPPEMMPTSPQSPRDAELIAEAKLLRQHKGRLEARMQILEDHNKQLESQLHRLRQLLEQPQAEA
KVNGATVSSPSTSLQRSDSSQPMLLRVVGSQTSDSMGEEDLLSPPQDTSTGLEEVMEQLNNSFPSSR
GHNVGSLFHMADDLGRAMESLVSVMTDEEGAE

NOV19 Clones

Unless specifically addressed as NOV19a or NOV19b, any reference to NOV19 is assumed to encompass all variants. NOV19a polypeptide is longer than the NOV19b polypeptide, having an additional 66 amino acids on the N-terminus. NOV19a also differs from NOV19b at four amino acid residues [aa 119 (W>L); aa 215 (N>Y); aa 255 (S>G); aa 607 (T>A)] as shown Table 19G.

A search against the Patp database, a proprietary database that contains sequences published in patents and patent publications, yielded several homologous proteins shown in Table 19E.

TABLE 19E

Patp results for NOV19

| Sequences producing High-scoring Segment Pairs: | Reading Frame | High Score | Smallest Sum Prob P (N) |
|---|---|---|---|
| >patp: AAY59237 A rod shortened dystrophin (deltaDysAx2) | +1 | 3127 | 0.0 |
| >patp: AAY59238 A rod shortened dystrophin (deltaDysAx11) | +1 | 3127 | 0.0 |
| >patp: AAY59239 A rod shortened dystrophin (deltaDysAH3) | +1 | 3127 | 0.0 |
| >patp: AAY59240 A rod shortened dystrophin (deltaDysM3) | +1 | 3127 | 0.0 |
| >patp: AAY59242 A rod shortened dystrophin (deltaDysH4) | +1 | 3127 | 0.0 |

TABLE 19E-continued

Patp results for NOV19

| Sequences producing High-scoring Segment Pairs: | Reading Frame | High Score | Smallest Sum Prob P (N) |
|---|---|---|---|
| >patp: AAP90290 Human Duchenne muscular dystrophy gene | +1 | 3120 | 0.0 |

In a BLAST search of public sequence databases, it was found, for example, that the NOV19a nucleic acid sequence of this invention has 1793 of 1798 bases (99%) identical to a gb:GENBANK-ID:HSDMDR|acc:X14298.1 mRNA from Homo sapiens (Human mRNA for MAJOR DUCHENNE MUSCULAR DYSTROPHY PROTEIN (DP71)). The NOV19a polypeptide sequence of the invention was found to have 620 of 635 amino acid residues (97%) identical to, and 620 of 635 amino acid residues (97%) similar to, the 622 amino acid residue ptnr:SPTREMBL-ACC:Q02295 protein from Homo sapiens (MAJOR DUCHENNE MUSCULAR DYSTROPHY PROTEIN (DP71)).

Similarly, it was found, for example, that the NOV19b nucleic acid sequence of this invention has 1793 of 1798 bases (99%) identical to a gb:GENBANK-ID:E30218|acc: E30218.1 mRNA from unidentified (Shortened dystrophin). The NOV19b polypeptide sequence of the invention also was found to have 620 of 635 amino acid residues (97%) identical to, and 620 of 635 amino acid residues (97%) similar to, the 622 amino acid residue ptnr:SPTREMBL-ACC:Q02295 protein from Homo sapiens (MAJOR DUCHENNE MUSCULAR DYSTROPHY PROTEIN (DP71)).

Additional BLAST results are shown in Table 19F.

TABLE 19F

BLAST results for NOV19

| Gene Index/ Identifier | Protein/Organism | Length (aa) | Identity (%) | Positives (%) | Expect |
|---|---|---|---|---|---|
| ptnr: SPTREMBL-ACC: Q02295 | DMD PROTEIN - Homo sapiens | 622 | 620/635 (97%) | 620/635 (97%) | 0.0 |
| ptnr: SWISSNEW-ACC: P11532 | Dystrophin - Homo sapiens | 3685 | 596/599 (99%) | 596/599 (99%) | 0.0 |
| ptnr: SPTREMBL-ACC: Q14205 | Dystrophin - Homo sapiens | 3127 | 596/599 (99%) | 596/599 (99%) | 0.0 |

A multiple sequence alignment is given in Table 19G, with the NOV19 protein of the invention being shown on line 1, in a ClustalW analysis comparing NOV19 with related protein sequences disclosed in Table 19F.

Table 19G. Information for the ClustalW proteins:

1. >NOV19a; SEQ ID NO:65
2. >NOV19b; SEQ ID NO:67
3. >Q02295/DMD PROTEIN [*Homo sapiens*]; SEQ ID NO:239
4. >P11532/ Dystrophin [*Homo sapiens*]; SEQ ID NO:240
5. >Q14205/ Dystrophin [*Homo sapiens*]; SEQ ID NO:241

```
                         2810      2820      2830      2840      2850
                    ....|....|....|....|....|....|....|....|....|....|
          NOV19a    ------WASRHT----------------PAPSGGSAESPAR-------
          NOV19b    ------------------------------------------------
          Q02295    ------------------------------------------------
          P11532    EASSDQWKRLHLSLQELLVWLQLKDDELSRQAPIGGDFPAVQKQNDVHRA
          Q14205    EASSDQWKRLHLSLQELLVWLQLKDDELSRQAPIGGDFPAVQKQNDVHRA 2860      2870      2880      2890      2900
                    ....|....|....|....|....|....|....|....|....|....|
          NOV19a    ---------------------------------PR-------------
          NOV19b    ------------------------------------------------
          Q02295    ------------------------------------------------
          P11532    FKRELKTKEPVIMSTLETVRIFLTEQPLEGLEKLYQEPRELPPEERAQNV
          Q14205    FKRELKTKEPVIMSTLETVRIFLTEQPLEGLEKLYQEPRELPPEERAQNV 2910      2920      2930      2940      2950
                    ....|....|....|....|....|....|....|....|....|....|
          NOV19a    -RLLR---------------SAFSCELGRRRRRRSTFGEPGGS-----
          NOV19b    ------------------------------------------------
          Q02295    ------------------------------------------------
          P11532    TRLLRKQAEEVNTEWEKLNLHSADWQRKIDETLERLQELQEATDELDLKL
          Q14205    TRLLRKQAEEVNTEWEKLNLHSADWQRKIDETLERLQELQEATDELDLKL 2960      2970      2980      2990      3000
                    ....|....|....|....|....|....|....|....|....|....|
          NOV19a    ------GKLTPP---LVPTLD--------RGALAAMREQLK-------
```

```
                                                     3010      3020      3030      3040      3050
                                                       ....|....|....|....|....|....|....|....|....|....|
NOV19b   ----------------------------------------MREQLK------
Q02295   ----------------------------------------MREQLK------
P11532   RQAEVIKGSWQPVGDLLIDSLQDHLEKVKALRGEIAPLKENVSHVNDLAR
Q14205   RQAEVIKGSWQPVGDLLIDSLQDHLEKVKALRGEIAPLKENVSHVNDLAR 3010      3020      3030      3040      3050
           ....|....|....|....|....|....|....|....|....|....|
NOV19a   --------------------------------------------------
NOV19b   --------------------------------------------------
Q02295   --------------------------------------------------
P11532   QLTTLGIQLSPYNLSTLEDLNTRWKLLQVAVEDRVRQLHEAHRDFGPASQ
Q14205   QLTTLGIQLSPYNLSTLEDLNTRWKLLQVAVEDRVRQLHEAHRDFGPASQ 3060      3070      3080      3090      3100
           ....|....|....|....|....|....|....|....|....|....|
NOV19a   ----------------------GHETQTTCWDHPKMTELYQSLADLNN
NOV19b   ----------------------GHETQTTCWDHPKMTELYQSLADLNN
Q02295   -----------------------HETQTTCWDHPKMTELYQSLADLNN
P11532   HFLSTSVQGPWERAISPNKVPYYINHETQTTCWDHPKMTELYQSLADLNN
Q14205   HFLSTSVQGPWERAISPNKVPYYINHETQTTCWDHPKMTELYQSLADLNN 3110      3120      3130      3140      3150
           ....|....|....|....|....|....|....|....|....|....|
NOV19a   VRFSAYRTAMKLRRLQKALCWDLLSLSAACDALDQHNLKQNDQPMDILQI
NOV19b   VRFSAYRTAMKLRRLQKALCLDLLSLSAACDALDQHNLKQNDQPMDILQI
Q02295   VRFSAYRTAMKLRRLQKALCLDLLSLSAACDALDQHNLKQNDQPMDILQI
P11532   VRFSAYRTAMKLRRLQKALCLDLLSLSAACDALDQHNLKQNDQPMDILQI
Q14205   VRFSAYRTAMKLRRLQKALCLDLLSLSAACDALDQHNLKQNDQPMDILQI 3160      3170      3180      3190      3200
           ....|....|....|....|....|....|....|....|....|....|
NOV19a   INCLTTIYDRLEQEHNNLVNVPLCVDMCLNWLLNVYDTGRTGRIRVLSFK
NOV19b   INCLTTIYDRLEQEHNNLVNVPLCVDMCLNWLLNVYDTGRTGRIRVLSFK
Q02295   INCLTTIYDRLEQEHNNLVNVPLCVDMCLNWLLNVYDTGRTGRIRVLSFK
P11532   INCLTTIYDRLEQEHNNLVNVPLCVDMCLNWLLNVYDTGRTGRIRVLSFK
Q14205   INCLTTIYDRLEQEHNNLVNVPLCVDMCLNWLLNVYDTGRTGRIRVLSFK 3210      3220      3230      3240      3250
           ....|....|....|....|....|....|....|....|....|....|
NOV19a   TGIISLCKAHLEDKYRNLFKQVASSTGFCDQRRLGLLLHDSIQIPRQLGE
NOV19b   TGIISLCKAHLEDKYRYLFKQVASSTGFCDQRRLGLLLHDSIQIPRQLGE
Q02295   TGIISLCKAHLEDKYRYLFKQVASSTGFCDQRRLGLLLHDSIQIPRQLGE
P11532   TGIISLCKAHLEDKYRYLFKQVASSTGFCDQRRLGLLLHDSIQIPRQLGE
Q14205   TGIISLCKAHLEDKYRYLFKQVASSTGFCDQRRLGLLLHDSIQIPRQLGE 3260      3270      3280      3290      3300
           ....|....|....|....|....|....|....|....|....|....|
NOV19a   VASFGGSNIEPSVRSCFQFANNKPEIEAALFLDWMRLEPQSMVWLPVLHR
NOV19b   VASFGGGNIEPSVRSCFQFANNKPEIEAALFLDWMRLEPQSMVWLPVLHR
Q02295   VASFGGSNIEPSVRSCFQFANNKPEIEAALFLDWMRLEPQSMVWLPVLHR
P11532   VASFGGSNIEPSVRSCFQFANNKPEIEAALFLDWMRLEPQSMVWLPVLHR
Q14205   VASFGGSNIEPSVRSCFQFANNKPEIEAALFLDWMRLEPQSMVWLPVLHR 3310      3320      3330      3340      3350
           ....|....|....|....|....|....|....|....|....|....|
NOV19a   VAAAETAKHQAKCNICKECPIIGFRYRSLKHFNYDICQSCFFSGRVAKGH
NOV19b   VAAAETAKHQAKCNICKECPIIGFRYRSLKHFNYDICQSCFFSGRVAKGH
Q02295   VAAAETAKHQAKCNICKECPIIGFRYRSLKHFNYDICQSCFFSGRVAKGH
P11532   VAAAETAKHQAKCNICKECPIIGFRYRSLKHFNYDICQSCFFSGRVAKGH
Q14205   VAAAETAKHQAKCNICKECPIIGFRYRSLKHFNYDICQSCFFSGRVAKGH 3360      3370      3380      3390      3400
           ....|....|....|....|....|....|....|....|....|....|
```

```
NOV19a    KMHYPMVEYCTPTTSGEDVRDFAKVLKNKFRTKRYFAKHPRMGYLPVQTV
NOV19b    KMHYPMVEYCTPTTSGEDVRDFAKVLKNKFRTKRYFAKHPRMGYLPVQTV
Q02295    KMHYPMVEYCTPTTSGEDVRDFAKVLKNKFRTKRYFAKHPRMGYLPVQTV
P11532    KMHYPMVEYCTPTTSGEDVRDFAKVLKNKFRTKRYFAKHPRMGYLPVQTV
Q14205    KMHYPMVEYCTPTTSGEDVRDFAKVLKNKFRTKRYFAKHPRMGYLPVQTV 3410      3420      3430      3440      3450
              ....|....|....|....|....|....|....|....|....|....|
NOV19a    LEGDNMETPVTLINFWPVDSAPASSPQLSHDDTHSRIEHYASRLAEMENS
NOV19b    LEGDNMETPVTLINFWPVDSAPASSPQLSHDDTHSRIEHYASRLAEMENS
Q02295    LEGDNMET------------PASSPQLSHDDTHSRIEHYASRLAEMENS
P11532    LEGDNMETPVTLINFWPVDSAPASSPQLSHDDTHSRIEHYASRLAEMENS
Q14205    LEGDNMETPVTLINFWPVDSAPASSPQLSHDDTHSRIEHYASRLAEMENS 3460      3470      3480      3490      3500
              ....|....|....|....|....|....|....|....|....|....|
NOV19a    NGSYLNDSISPNESIDDEHLLIQHYCQSLNQDSPLSQPRSPAQILISLES
NOV19b    NGSYLNDSISPNESIDDEHLLIQHYCQSLNQDSPLSQPRSPAQILISLES
Q02295    NGSYLNDSISPNESIDDEHLLIQHYCQSLNQDSPLSQPRSPAQILISLES
P11532    NGSYLNDSISPNESIDDEHLLIQHYCQSLNQDSPLSQPRSPAQILISLES
Q14205    NGSYLNDSISPNESIDDEHLLIQHYCQSLNQDSPLSQPRSPAQILISLES 3510      3520      3530      3540      3550
              ....|....|....|....|....|....|....|....|....|....|
NOV19a    EERGELERILADLEEENRNLQAEYDRLKQQHEHKGLSPLPSPPEMMPTSP
NOV19b    EERGELERILADLEEENRNLQAEYDRLKQQHEHKGLSPLPSPPEMMPTSP
Q02295    EERGELERILADLEEENRNLQAEYDRLKQQHEHKGLSPLPSPPEMMPTSP
P11532    EERGELERILADLEEENRNLQAEYDRLKQQHEHKGLSPLPSPPEMMPTSP
Q14205    EERGELERILADLEEENRNLQAEYDRLKQQHEHKGLSPLPSPPEMMPTSP 3560      3570      3580      3590      3600
              ....|....|....|....|....|....|....|....|....|....|
NOV19a    QSPRDAELIAEAKLLRQHKGRLEARMQILEDHNKQLESQLHRLRQLLEQP
NOV19b    QSPRDAELIAEAKLLRQHKGRLEARMQILEDHNKQLESQLHRLRQLLEQP
Q02295    QSPRDAELIAEAKLLRQHKGRLEARMQILEDHNKQLESQLHRLRQLLEQP
P11532    QSPRDAELIAEAKLLRQHKGRLEARMQILEDHNKQLESQLHRLRQLLEQP
Q14205    QSPRDAELIAEAKLLRQHKGRLEARMQILEDHNKQLESQLHRLRQLLEQP 3610      3620      3630      3640      3650
              ....|....|....|....|....|....|....|....|....|....|
NOV19a    QAEAKVNGTTVSSPSTSLQRSDSSQPMLLRVVGSQTSDSMGEEDLLSPPQ
NOV19b    QAEAKVNGATVSSPSTSLQRSDSSQPMLLRVVGSQTSDSMGEEDLLSPPQ
Q02295    QAEAKVNGTTVSSPSTSLQRSDSSQPMLLRVVGSQTSDSMGEEDLLSPPQ
P11532    QAEAKVNGTTVSSPSTSLQRSDSSQPMLLRVVGSQTSDSMGEEDLLSPPQ
Q14205    QAEAKVNGTTVSSPSTSLQRSDSSQPMLLRVVGSQTSDSMGEEDLLSPPQ 3660      3670      3680      3690      3700
              ....|....|....|....|....|....|....|....|....|....|
NOV19a    DTSTGLEEVMEQLNNSFPSSRGHNVGSLFHMADDLGRAMESLVSVMTDEE
NOV19b    DTSTGLEEVMEQLNNSFPSSRGHNVGSLFHMADDLGRAMESLVSVMTDEE
Q02295    DTSTGLEEVMEQLNNSFPSSRGHNVGSLFHMADDLGRAMESLVSVMTDEE
P11532    DTSTGLEEVMEQLNNSFPSSRGRNT----P-----GKPMR--EDTM----
Q14205    DTSTGLEEVMEQLNNSFPSSRGRNT----P-----GKPMR--EDTM----

NOV19a    GAE
NOV19b    GAE
Q02295    GAE
P11532    ---
Q14205    ---
```

The NOV19 Clustal W alignment shown in Table 19G was modified to begin at amino residue 2801. The data in Table 19G includes all of the regions overlapping with the NOV19 protein sequences.

The presence of identifiable domains in the protein disclosed herein was determined by searches using algorithms such as PROSITE, Blocks, Pfam, ProDomain, Prints and then determining the Interpro number by crossing the domain match (or numbers) using the Interpro website (http:www.ebi.ac.uk/interpro/). Table 19H lists the domain description from DOMAIN analysis results against NOV19.

TABLE 19H

Domain Analysis of NOV19

| Model | Region of Homology | Score (bits) | E value |
|---|---|---|---|
| ZZ zinc finger | 305–350 | 93.3 | 4.9e-24 |
| Ribosomal_L24e | 248–308 | −25.9 | 3.4 |
| M Protein Signature | 499–519 | 9.4 | 38 |
| M Protein Signature | 565–585 | 5.1 | 1.5e+02 |

Consistent with other known members of the DP71 family of proteins, NOV19 contains a zinc finger ZZ domain as illustrated in Table 19H. NOV19 nucleic acids, and the encoded polypeptides, according to the invention are useful in a variety of applications and contexts. For example, NOV19 nucleic acids and polypeptides can be used to identify proteins that are members of the DP71 family of proteins. The NOV19 nucleic acids and polypeptides can also be used to screen for molecules, which inhibit or enhance NOV19 activity or function. Specifically, the nucleic acids and polypeptides according to the invention may be used as targets for the identification of small molecules that modulate or inhibit, e.g., cellular activation, cellular metabolism and signal transduction. These molecules can be used to treat, e.g., deafness 4, congenital sensorineural, Duchenne muscular dystrophy, Becker muscular dystroph, cardiomyopathy, dilated, X-linked, McLeod phenotype, Lesch-Nyhan syndrome, myasthenia gravis, Adrenal hypoplasia, congenital, with hypogonadotropic hypogonadism, Dosage-sensitive sex reversal, Glycerol kinase deficiency; Gonadal dysgenesis, XY female type, Hyperglycerolemia, diabetes, obesity, and Retinitis pigmentosa-6.

In addition, various NOV19 nucleic acids and polypeptides according to the invention are useful, inter alia, as novel members of the protein families according to the presence of domains and sequence relatedness to previously described proteins. For example, the NOV19 nucleic acids and their encoded polypeptides include structural motifs that are characteristic of proteins belonging to the family of DP71 such as the Major Duchenne Muscular Dystrophy proteins involved in skeletal muscle and nerve physiology.

Duchenne muscular dystrophy (DMD) is an X-linked recessive disorder which manifest as a progressive degeneration of muscles and results in death. A less severe disorder, Becker's muscular dystrophy (BMD), is allelic to DMD. Some 30% of DMD patients also suffer also from mental retardation. The DMD gene is the largest known gene, consisting of almost 0.1% of the human genome (2,500 Kbp). The product of the DMD gene in the muscle, dystrophin, is a 427 kDa protein translated from a 14 kb mRNA. Dystrophin is a rod-shaped protein consisting of an actin binding N-terminal domain, a large domain of spectrin-like repeats, a cystein-rich domain with potential Ca2+ binding sites, and a C-terminal domain. A very similar isoform of dystrophin, encoded by the same gene, is found in the brain. The expression of the two isoforms is regulated by two promoters. One is active in muscle cells and glia cells. The other is active mainly in neurons. A 70.8 kDa protein, called Dp71, is the product of a promoter located between exons 62 and 63 of the DMD gene.

Dp71 is of special interest as it consists of the cysteine-rich and C-terminal domains of dystrophin, but lacks the actin binding domain and the spectrin-like repeats. Dp7 is by far the major product of the DMD gene in brain and many other nonmuscle tissues. Analysis of the expression of the DMD gene products during development has shown that Dp71 is already expressed in the embryonic stem cells. The known dystrophins and their mRNAs are detected only after differentiation of specialized cell types.

The NOV19 nucleic acids and polypeptides, antibodies and related compounds according to the invention will be useful in therapeutic and diagnostic applications in the mediation of muscle and nerve physiology. As such, the NOV19 nucleic acids and polypeptides, antibodies and related compounds according to the invention may be used to treat muscle and nervous system disorders, e.g., Duchenne muscular dystrophy, Becker muscular dystroph, cardiomyopathy, dilated, X-linked, McLeod phenotype, Lesch-Nyhan syndrome, myasthenia gravis.

The NOV19 nucleic acids and polypeptides are useful for detecting specific cell types. For example, expression analysis has demonstrated that a NOV19 nucleic acid is expressed in Adipose, Aorta, Vein, Umbilical Vein, Adrenal Gland/Suprarenal gland, Pancreas, Thyroid, Parotid Salivary glands, Stomach, Liver, Colon, Bone Marrow, Peripheral Blood, Spleen, Lymph node, Tonsils, Bone, Cartilage, Muscle, Skeletal Muscle, Brain, Cerebellum, Left cerebellum, Thalamus, Pituitary Gland, Temporal Lobe, Amygdala, Substantia Nigra, Hippocampus, Spinal Chord, Cervix, Mammary gland/Breast, Ovary, Placenta, Uterus, Oviduct/Uterine Tube/Fallopian tube, Prostate, Testis, Lung, Kidney, Retina, Cochlea, and Foreskin.

Additional utilities for NOV19 nucleic acids and polypeptides according to the invention are disclosed herein.

NOV20

A NOV20 polypeptide has been identified as a G Protein-Coupled Receptor RTA (GPCR)-like protein. The novel NOV20 nucleic acid sequences maps to the chromosome11. Two alternative novel NOV20, NOV20a and NOV20b, nucleic acids and encoded polypeptides are provided.

NOV20a

A NOV20 variant is the novel NOV20a (alternatively referred to herein as CG56517-01), which includes the 1219 nucleotide sequence (SEQ ID NO:68) shown in Table 20A. A NOV20a ORF begins with a Kozak onsensus sequence ATG initiation codon at nucleotides 31–33 and ends with a TGA codon at nucleotides 1051–1053. Putative untranslated regions upstream from the initiation codon and downstream from the termination codon are underlined in Table 20A, and the start and stop codons are in bold letters.

TABLE 20A

NOV20a Nucleotide Sequence (SEQ ID NO:68)

AGCAGGGGCCCAGACGCGCCAGGCCTGGAGATGGCTGGAAACTGCTCCTGGGAGGCCCATCCCGGCA
ACAGGAACAAGATGTGCCCTGGCCTGAGCGAGGCCCCGGAACTCTACAGCCGGGGCTTCCTGACCAT
CGAGCAGATCGCGATGCTGCCGCCTCCGGCCGTCATGAACTACATCTTCCTGCTCCTCTGCCTGTGT
GGCCTGGTGGGCAACGGGCTGGTCCTCTGGTTTTTCGGCTTCTCCATCAAGAGGAACCCCTTCTCCA
TCTACTTCCTGCACCTGGCCAGCGCCGATGTGGGCTACCTCTTCAGCAAGGCGGTGTTCTCCATCCT
GAACACGGGGGGCTTCCTGGGCACGTTTGCCGACTACATCCGCAGCGTGTGCCGGGTCCTGGGGCTC
TGCATGTTCCTTACCGGCGTGAGCCTCCTGCCGGCCGTCAGCGCGTCAGCGTGCGCCTCGGTCATCT
TCCCCGCCTGGTACTGGCGCCGGCGGCCCAAGCGCCTGTCGGCCGTGGTGTGCGCCCTGCTGTGGGT
CCTGTCCCTCCTGGTCACCTGCCTGCACAACTACTTCTGCGTGTTCCTGGGCCGCGGGGCCCCGGGC
GCGTGCTGCAGGCACATGGACATCTTCCTGGGCATCCTCCTGTTCCTGCTCTGCTGCCCGCTCATGG
TGCTGCCCTGCCTGGCCCTCATCCTGCACGTGGAGTGCGGGCCCGACGGGCCACGCTCTGCCAAGCT
CAAGCACGTCATCCTGGCCATGGTCTCCGTCTTCCTGGTGTCCTCCATCTACTTAGGGATCGACTGG
TTCCTCTTCTGGGTCTTCCAGATCCCGGCCCCCTTCCCCGAGTACGTCACTGACCTGTGCATCTGCA
TCAACAGCAGCGCCAAGCCCATCGTCTACTTCCTGGCCGGGAGGACAAGTCGCAGCGGCTGTTGGAG
CCTTAGGGTGGTCTTCAGTGGGGCCTGCGGGACGGCGCTGACTGGGGGATGTCGGGGCAGCACGCTC
AACACAGTCACCATGGAGATGCAGTGTCCCCCGGGGAACGCCTCCTGAGACTGCAGCGCCTGGAGGA
GGCAGTGGCAGGAATCGTGCTCCAAGACTCTTCTGCTGTGGACAGGAATGGGCACTAGTTCTGAGTC
CATACAGGAGAGGAAAGATCTGTATGCTCTCCTCGGGCCTTCTTCTCCCTGGGACTGTGGAACTCAG
GTAGTGTCTGGGC

The NOV20a polypeptide (SEQ ID NO:69) encoded by SEQ ID NO:68 is 340 amino acid residues in length and is presented using the one-letter amino acid code in Table 20B. The Psort profile for the NOV20a and NOV20b proteins predicts that this peptides are likely to be localized at the plasma membrane with a certainty of 0.6000. The Signal P predicts a likely cleavage site for a NOV20 peptide is between positions 67 and 68, i.e., at the dash in the sequence VLW-FF.

CAGCTGCAGGTGGGT-3' (SEQ ID NO:242) and 5'-TCTCCTGTATGGACTCAGAAGAAGGTG-3' (SEQ ID NO:243). Primers were designed based on in silico predictions of the fall length or some portion (one or more exons) of the cDNA/protein sequence of the invention. The PCR product derived by exon linking, covering the entire open reading frame, was cloned into the pCR2.1 vector from Invitrogen to provide clone CG56517-01.698754.A13.

TABLE 20B

NOV20a protein sequence (SEQ ID NO:69)

MAGNCSWEAHPGNRNKMCPGLSEAPELYSRGFLTIEQIAMLPPPAVMNYIFLLLCLCGLVGNGLVLW
FFGFSIKRNPFSIYFLHLASADVGYLFSKAVFSILNTGGFLGTFADYIRSVCRVLGLCMFLTGVSLL
PAVSASACASVIFPAWYWRRRPKRLSAVVCALLWVLSLLVTCLHNYFCVFLGRGAPGACCRHMDIFL
GILLFLLCCPLMVLPCLALILHVECGPDGPRSAKLKHVILAMVSVFLVSSIYLGIDWFLFWVFQIPA
PFPEYVTDLCICINSSAKPIVYFLAGRTSRSGCWSLRVVFSGACGTALTGGCRGSTLNTVTMEMQCP
PGNAS

NOV20b

Alternatively, a NOV20 variant is the novel NOV20b (alternatively referred to herein as CG56517-02), which includes the 1113 nucleotide sequence (SEQ ID NO:70) shown in Table 20C. NOV20b was created by polymerase chain reaction (PCR) using the primers: 5'-ATCAGGA- The NOV20b ORF begins with a Kozak consensus ATG initiation codon at nucleotides 73–75 and ends with a TGA codon at nucleotides 1102–1104. Putative untranslated regions upstream from the initiation codon and downstream from the termination codon are underlined in Table 20C, and the start and stop codons are in bold letters.

TABLE 20C

NOV20b Nucleotide Sequence (SEQ ID NO:70)

ATCAGGACAGCTGCAGGTGGGTGTGCAGACTGGTGAGCTGCCAGCAGGGGCCCAGACGCGCCAGGCC
TGGAGATGGCTGGAAACTGCTCCTGGGAGGCCCATCCCGGCAACAGGAACAAGATGTGCCCTGGCCT
GAGCGAGGCCCCGGAACTCTACAGCCGGGGCTTCCTGACCATCGAGCAGATCGCGATGCTGCCGCCT
CCGGCCGTCATGAACTACATCTTCCTGCTCCTCTGCCTGTGTGGCCTGGTGGGCAACGGGCTGGTCC
TCTGGTTTTTCGGCTTCTCCATCAAGAGGAACCCCTTCTCCATCTACTTCCTGCACCTGGCCAGCGC
CGATGTGGGCTACCTCTTCAGCAAGGCGGTGTTCTCCATCCTGAACACGGGGGGCTTCCTGGGCACG
TTTGCCGACTACATCCGCAGCGTGTGCCGGGTCCTGGGGCTCTGCATGTTCCTTACCGGCGTGAGCC
TCCTGCCGGCCGTCAGCGCCGAGCGCTGCGCCTCGGTCATCTTCCCCGCCTGGTACTGGCGCCGGCG
GCCCAAGCGCCTGTCGGCCGTGGTGTGCGCCCTGCTGTGGGTCCTGTCCCTCCTGGTCACCTGCCTG
CACAACTACTTCTGCGTGTTCCTGGGCCGCGGGGCCCCGGCGCGGCCTGCAGGCACATGGACATCT
TCCTGGGCATCCTCCTGTTCCTGCTCTGCTGCCCGCTCATGGTGCTGCCCTGCCTGGCCCTCATCCT
GCACGTGGAGTGCGGGCCCGACGGCGCCAGCGCTCTGCCAAGCTCAACCACGTCATCCTGGCCATG
GTCTCCGTCTTCCTGGTGTCCTCCATCTACTTAGGGATCGACTGGTTCCTCTTCTGGGTCTTCCAGA
TCCCGGCCCCCTTCCCCGAGTACGTCACTGACCTGTGCATCTGCATCAACAGCAGCGCCAAGCCCAT

TABLE 20C-continued

NOV20b Nucleotide Sequence (SEQ ID NO:70)

CGTCTACTTCCTGGCCGGGAGGGACAAGTCGCAGCGGCTGTGGGAGCCGCTCAGGGTGGTCTTCCAG
CGGGCCCTGCGGGACGGCGCTGAGCTGGGGGAGGCCGGGGGCAGCACGCCCAACACAGTCACCATGG
AGATGCAGTGTCCCCCGGGGAACGCCTCCTGAGACTCCAGC

The NOV20b protein (SEQ ID NO:71) encoded by SEQ ID NO:70 is 343 amino acid residues in length and is presented using the one-letter code in Table 20D.

TABLE 20D

NOV20b protein sequence (SEQ ID NO:71)

MAGNCSWEAHPGNRNKMCPGLSEAPELYSRGFLTIEQIAMLPPPAVMNYIFLLLCLCGLVG
NGLVLWFFGFSIKRNPFSIYFLHIASADVGYLFSKAVFSILNTGGFLGTFADYIRSVCRVL
GLCMFLTGVSLLPAVSAERCASVIFPAWYWRRRPKRLSAVVCALLWVLSLLVTCLHNYFCV
FPGRGAPGAACRHMDIFLGILLFLLCCPLMVLPCLALILHVECRARRRQRSAKLNHVILAM
VSVFLVSSiYLGIDWFLFWVFQIPAPFPEYVTDLCICINSSAKPIVYFLAGRDKSQRLWEP
LRVVFQRALRDGAELGEAGGSTPNTVTMEMQCPPGNAS

NOV20 Clones

Unless specifically addressed as NOV20a or NOV20b, any reference to NOV20 is assumed to encompass all variants. NOV20b has four frame-shifts at position 762, 959, 986, and 1042 bp, respectively, when compared with NOV20a. These frame-shifts result in numerous amino acid differences between NOV20a and NOV20b.

A search against the Patp database, a proprietary database that contains sequences published in patents and patent publications, yielded several homologous proteins shown in Table 20E and Table 20F.

TABLE 20E

Patp results for NOV20a

| Sequences producing High-scoring Segment Pairs: | Reading Frame | High Score | Smallest Sum Prob P (N) |
|---|---|---|---|
| >patp:AAB88477 Human membrane clone PSEC0142 | +1 | 1625 | 7.9e−167 |
| >patp:AAR97222 Human G-protein coupled receptor | +1 | 1591 | 3.2e−163 |
| >patp:AAR96145 G protein coupled receptor protein | +1 | 1404 | 2.1e−143 |

TABLE 20F

Patp results for NOV20b

| Sequences producing High-scoring Segment Pairs: | Reading Frame | High Score | Smallest Sum Prob P (N) |
|---|---|---|---|
| >patp:AAB88477 Human membrane clone PSEC0142 | +1 | 1826 | 3.9e−188 |
| >patp:AAR97222 Human G-protein coupled receptor | +1 | 1792 | 1.6e−184 |
| >patp:AAR96145 G protein coupled receptor protein | +1 | 1589 | 5.1e−163 |

In a BLAST search of public sequence databases, it was found, for example, that the NOV20a nucleic acid sequence of this invention has 840 of 1032 bases (81%) identical to a gb:GENBANK-ID:RATRTA|acc:M35297.1 mRNA from *Rattus norvegicus* probableG protein-coupled receptor (RTA) mRNA, complete cds. NOV20a protein of the invention was found to have 265 of 343 amino acid residues (77%) identical to, and 280 of 343 amino acid residues (81%) similar to, the 343 amino acid residue ptnr:SWISSPROT-ACC:P23749 protein from probable *Rattus norvegicus* G protein-coupled receptor RTA.

Similarly, it was found, for example, that the NOV20b nucleic acid sequence of this invention has 903 of 1086 bases (83%) identical to a gb:GENBANK-ID:RATRTA|acc:M35297.1 mRNA from *Rattus norvegicus* G protein-coupled receptor (RTA) mRNA, complete cds. NOV20b protein of the invention was found to have 291 of 343 amino acid residues (84%) identical to, and 307 of 343 amino acid residues (89%) similar to, the 343 amino acid residue ptnr:SWISSPROT-ACC:P23749 protein from *Rattus norvegicus* probable G protein-coupled receptor RTA.

Additional BLAST results are shown in Table 20G.

TABLE 20G

BLAST results for NOV20a

| Gene Index/ Identifier | Protein/Organism | Length (aa) | Identity (%) | Positives (%) | Expect |
|---|---|---|---|---|---|
| ptnr:SPTREMBL-ACC:Q96AM1 | HYPOTHETICAL 38.2 KDA PROTEIN - Homo sapiens | 343 | 314/343 (91%) | 314/343 (91%) | 4.8e-167 |
| ptnr:REMTREMBL-ACC:CAC39840 | SEQUENCE 321 FROM PATENT EP1067182 - Homo sapiens | 343 | 313/343 (91%) | 314/343 (91%) | 1.0e-166 |
| ptnr:SWISSPROT-ACC:P23749 | Probable G protein-coupled receptor RTA - Rattus norvegicus | 343 | 265/343 (77%) | 280/343 (81%) | 1.7e-139 |
| ptnr:SPTREMBL-ACC:Q91ZB6 | G PROTEIN-COUPLED RECEPTOR - Mus musculus | 319 | 249/318 (78%) | 261/318 (82%) | 1.6e-129 |

TABLE 20H

BLAST results for NOV20b

| Gene Index/ Identifier | Protein/Organism | Length (aa) | Identity (%) | Positives (%) | Expect |
|---|---|---|---|---|---|
| ptnr:SPTREMBL-ACC:Q96AM1 | HYPOTHETICAL 38.2 KDA PROTEIN - Homo sapiens | 343 | 342/343 (99%) | 342/343 (99%) | 2.4e-188 |
| ptnr:REMTREMBL-ACC:CAC39840 | SEQUENCE 321 FROM PATENT EP1067182 - Homo sapiens | 343 | 341/343 (99%) | 342/343 (99%) | 5.0e-188 |
| ptnr:SWISSPROT-ACC:P23749 | Probable G protein-coupled receptor RTA - Rattus norvegicus | 343 | 291/343 (84%) | 307/343 (89%) | 5.4e-159 |
| ptnr:SPTREMBL-ACC:Q91ZB6 | G PROTEIN-COUPLED RECEPTOR - Mus musculus | 319 | 274/318 (86%) | 287/318 (90%) | 1.0e-148 |

A multiple sequence alignment is given in Table 20I, with the NOV20 protein of the invention being shown on line 1, in a ClustalW analysis comparing NOV20 with related protein sequences disclosed in Table 20G and Table 20H.

Table 20I. Information for the ClustalW proteins:

1. >NOV20a; SEQ ID NO:69
2. >NOV20b; SEQ ID NO:71
3. >Q96AM1/ Hypothetical Protein 38.2 [*Homo sapiens*]; SEQ ID NO:244
4. >CAC39840/ Sequence 321 from Patent EP1067182 [*Homo sapiens*]; SEQ ID NO:245
5. >P23749/ Probable G protein-coupled receptor RTA [*Homo sapiens*]; SEQ ID NO:246
6. >Q91ZB6/ G protein-coupled receptor [*Mus musculus*]; SEQ ID NO:247

```
                    10        20        30        40        50
             ....|....|....|....|....|....|....|....|....|....|
    NOV20a   MAGNCSWEAHPGNRNKMCPGLSEAPELYSRGFLTIEQIAMLPPPAVMNYI
    NOV20b   MAGNCSWEAHPGNRNKMCPGLSEAPELYSRGFLTIEQIAMLPPPAVMNYI
```

```
                   Q96AM1     MAGNCSWEAHPGNRNKMCPGLSEAPELYSRGFLTIEQIAMLPPPAVMNYI
                   CAC39840   MAGNCSWEAHPGNRNRMCPGLSEAPELYSRGFLTIEQIAMLPPPAVMNYI
                   P23749     -AGNCSWEAHSTNQNKMCPGMSEALELYSRGFLTIEQIATLPPPAVTNYI
                   Q91ZB6     ------------------------RELYSRGFLTIEQIATLPPPAVTNYI 60        70        80        90       100
                                ....|....|....|....|....|....|....|....|....|....|
                   NOV20a     FLLLCLCGLVGNGLVLWFFGFSIKRNPFSIYFLHLASADVGYLFSKAVFS
                   NOV20b     FLLLCLCGLVGNGLVLWFFGFSIKRNPFSIYFLHLASADVGYLFSKAVFS
                   Q96AM1     FLLLCLCGLVGNGLVLWFFGFSIKRNPFSIYFLHLASADVGYLFSKAVFS
                   CAC39840   FLLLCLCGLVGNGLVLWFFGFSIKRTPFSIYFLHLASADGIYLFSKAVIA
                   P23749     FLLLCLCGLVGNGLVLWFFGFSIKRTPFSIYFLHLASADGMYLFSKAVIA
                   Q91ZB6     FLLLCLCGLVGNGLVLWFFGFSIKRTPFSIYFLHLASADGMYLFSKAVIA 110       120       130       140       150
                                ....|....|....|....|....|....|....|....|....|....|
                   NOV20a     ILNTGGFLGTFADYIRSVCRVLGLCMFLTGVSLLPAVSASACASVIFPAW
                   NOV20b     ILNTGGFLGTFADYIRSVCRVLGLCMFLTGVSLLPAVSAERCASVIFPAW
                   Q96AM1     ILNTGGFLGTFADYIRSVCRVLGLCMFLTGVSLLPAVSAERCASVIFPAW
                   CAC39840   ILNTGGFLGTFADYIRSVCRVLGLCMFLTGVSLLPAVSAERCASVIFPAW
                   P23749     LLNMGTFLGSFPDYVRRVSRIVGLCTFFAGVSLLPAISIERCVSVIFPMW
                   Q91ZB6     LLNMGTFLGSFPDYIRRVSRIVGLCTFFTGVSLLPAISIERCVSVIFPTW 160       170       180       190       200
                                ....|....|....|....|....|....|....|....|....|....|
                   NOV20a     YWRRRPKRLSAVVCALLWVLSLLVTCLHNYFCVFLGRGAPGACRHMDIF
                   NOV20b     YWRRRPKRLSAVVCALLWVLSLLVTCLHNYFCVFPGRGAPGAACRHMDIF
                   Q96AM1     YWRRRPKRLSAVVCALLWVLSLLVTCLHNYFCVFLGRGAPGAACRHMDIF
                   CAC39840   YWRRRPKRLSAVVCALLWVLSLLVTCLHNYFCVFLGRGAPGAACRHMDIF
                   P23749     YWRRRPKRLSAGVCALLWLLSFLVTSIHNYFCMFLGHEASGTACLNMDIS
                   Q91ZB6     YWRRRPKRLSAGVCALLWMLSFLVTSIHNYFCMFLGHEAPGTVCRNMDIA 210       220       230       240       250
                                ....|....|....|....|....|....|....|....|....|....|
                   NOV20a     LGILLFLLCCPLMVLPCLALILHVECGPDG-PRSAKLKHVILAMVSVFLV
                   NOV20b     LGILLFLLCCPLMVLPCLALILHVECRARRRQRSAKLNHVILAMVSVFLV
                   Q96AM1     LGILLFLLCCPLMVLPCLALILHVECRARRRQRSAKLNHVILAMVSVFLV
                   CAC39840   LGILLFLLCCPLMVLPCLALILHVECRARRRQRSAKLNHVILAMVSVFLV
                   P23749     LGILLFFLFCPLMVLPCLALILHVECRARRRQRSAKLNHVVLAIVSVFLV
                   Q91ZB6     LGILLFFLFCPLMVLPCLALILHVECRARRRQRSAKLNHVVLAIVSVFLV 260       270       280       290       300
                                ....|....|....|....|....|....|....|....|....|....|
                   NOV20a     SSIYLGIDWFLFWVFQIPAPFPEYVTDLCICINSSAKPIVYFLAGRTSRS
                   NOV20b     SSIYLGIDWFLFWVFQIPAPFPEYVTDLCICINSSAKPIVYFLAGRDKSQ
                   Q96AM1     SSIYLGIDWFLFWVFQIPAPFPEYVTDLCICINSSAKPIVYFLAGRDKSQ
                   CAC39840   SSIYLGIDWFLFWVFQIPAPFPEYVTDLCICINSSAKPIVYFLAGRDKSQ
                   P23749     SSIYLGIDWFLFWVFQIPAPFPEYVTDLCICINSSAKPIVYFLAGRDKSQ
                   Q91ZB6     SSIYLGIDWFLFWVFQIPAPFPEYVTDLCICINSSAKPIVYFLAGRDKSQ 310       320       330       340
                                ....|....|....|....|....|....|....|....|....
                   NOV20a     GCWS-LRVVFSGACGT-ALTGGCRGSTLNTVTMEMQCPPGNAS
                   NOV20b     RLWEPLRVVFQRALRDGAELGEAGGSTPNTVTMEMQCPPGNAS
                   Q96AM1     RLWEPLRVVFQRALRDGAELGEAGGSTPNTVTMEMQCPPGNAS
                   CAC39840   RLWEPLRVVFQRALRDGAELGEAGGSTPNTVTMEMQCPPGNAS
                   P23749     RLWEPLRVVFQRALRDGAEPGDAASSTPNTVTMEMQCPSGNAS
                   Q91ZB6     RLWEPLRVVFQRALRDGAEPGDAASSTPNTVTMEMQCPSGNAS
```

The presence of identifiable domains in the protein disclosed herein was determined by searches using algorithms such as PROSITE, Blocks, Pfam, ProDomain, Prints and then determining the Interpro number by crossing the domain match (or numbers) using the Interpro website (http:www.ebi.ac.uk/interpro/). The DOMAIN analysis results indicate that the NOV20 protein contains the following protein domain (as defined by Interpro): domain name 7tm_1 7 transmembrane receptor (rhodopsin family). DOMAIN results for NOV20 were collected from the Conserved Domain Database (CDD) with Reverse Position Specific BLAST. This BLAST samples domains found in the Smart and Pfam collections.

As discussed below, the NOV20 protein of the invention contained significant homology to the 7tm_1 domain. This indicates that the NOV20 sequence has properties similar to those of other proteins known to contain this 7tm_1 domain and similar to the properties of these domains. The 254 amino acid domain termed 7tm_1 (SEQ ID NO:248; Pfam Acc. No. 00001) a seven transmembrane receptor (rhodopsin family), is shown in Table 20J.

TABLE 20J

7tm_1, 7 transmembrane receptor domain (SEQ ID NO:248)

GNLLVILVILRTKKLRTPTNIFLLNLAVADLLFLLTLPPWALYYLVGGDWVFGDALCKLVGALFVVNGYASILLLTAISIDRYL
AIVHPLRYRRIRTPRRAKVLILLVWVLALLLSLPPLLFSWLRTVEEGNTTVCLIDFPEESVKRSYVLLSTLVGFVLPLLVILVC
YTRILRTLRKRARSQRSLKRRSSSERKAAKMLLVVVVVFVLCWLPYHIVLLLDSLCLLSIWRVLPTALLITLWLAYVNSCLNPI
IY

The DOMAIN results are listed in Table 20K and Table 20L with the statistics and domain description. An alignment of NOV20a residues 61–290 (SEQ ID NO:68) with the full 7tm_1 domain, residues 1–254 (SEQ ID NO:248), are shown in Table 20K. A similar alignment of NOV20b residues 61–290 (SEQ ID NO:70), are shown in Table 20L. This indicates that the NOV20 sequences have properties similar to those of other proteins known to contain this domain as well as to the 254 amino acid 7tm domain (SEQ ID NO:248). For Table 20K and Table 20L, fully conserved single residues are indicated by the vertical line and "strong" semi-conserved residues are indicated by the "plus sign." The "strong" group of conserved amino acid residues may be any one of the following groups of amino acids: STA, NEQK, NHQK, NDEQ, QHRK, MILV, MILF, HY, FYW.

TABLE 20K

Domain Analysis of NOV20a

| PSSMs producing significant alignments: | Score (bits) | E value |
|---|---|---|
| gnl|Pfam|pfam00001 7tm_1, 7 transmembrane receptor (rhodopsin family) | 72.2 | 4.9e-22 |

```
                *->GNlLVilvilrtkklrtptnifilNLAvADLLflltlppwalyylvg
                   ||+||++ +++    |+|++|++|+|| ||  +|++ ++++++  |
NOV20a    61       GNGLVLWFFGF-SIKRNPFSIYFLHLASADVGYLFSKAVFSILNTGG   106 gsedWpfGsalCklvtaldvvnmyaSillLtaISiDRYlAIvhPlryrrr
                 +   | ++   +   |+++ + +++ || | |   + +++ | +|+||
NOV20a   107    --FLGTFADYIRSVCRVLGLCMFLTGVSLLPAVSASACASVIFPAWYWRR   154 rtsprrAkvvillvWvlalllslPpllfswvktveegngtlnvnvtvCli
                |  +|+ +||++|  |||+||++ ++ +|+        +          |+
NOV20a   155    RP-KRLSAVVCALLWVLSLLVTCLHNYFCVFLGRGAP-------GACCRH   196 dfpeestasvstwlrsyvllstlvgFllPllvilvcYtrIlrtlr.....
                +               ++| +|++ |++ |+  |    +||++ ++++++
NOV20a   197    M--------------DIFLGILLFLLCCPLMVLPCLALILHVECgpdgp   231

...kaaktllvvvvvFvlCWlPyfivllldtlc.lsiimsstCelervlp
                ++ |+ +++|+ |+||+++   +  | ++|+++++++          |
NOV20a   232    rsaKLKHVILAMVSVFLVSSIYLGIDWFLFWVFqIP------------AP   269 tallvtlwLayvNsclNPilY<-*         (SEQ ID NO:248)
                ++ +||  ++ ++||   ||+ |
NOV20a   270    FPEYVTDLCICINSSAKPIVY   290       (SEQ ID NO:69)
```

TABLE 20L

Domain Analysis of NOV20b

| PSSMs producing significant alignments: | Score (bits) | E value |
|---|---|---|
| gnl|Pfam|pfam00001 7tm_1, 7 transmembrane receptor (rhodopsin family) | 102.2 | 1.7e-31 |

```
                *->GNlLVilvilrtkklrtptnifilNLAvADLLflltlppwalyylvg
                   ||+||++ +++     |+|++|++|+||  ||  +|++  ++++++   |
NOV20b      61     GNGLVLWFFGF-SIKRNPFSIYFLHLASADVGYLFSKAVFSILNTGG   106 gsedWpfGsalCklvtaldvvnmyaSillLtaISiDRYlAIvhPlryrrr
                      +   | ++    +    |+++ + +++ ||   |  +|+ +++  | +|+||
NOV20b      107    --FLGTFADYIRSVCRVLGLCMFLTGVSLLPAVSAERCASVIFPAWYWRR   154 rtsprrAkvvillvWvlalllslPpllfswvktveegngtlnvnvtvCli
                   |  +|+ +||++|  |||+||++ ++ +|  + ++   | +       +|+
NOV20b      155    RP-KRLSAVVCALLWVLSLLVTCLHNYF--CVFPGRGAP-----GAACRH   196 dfpeestasvstwlrsyvllstlvgFllPllvilvcYtrIlrtlr.....
                   +              ++| +|++ |++ |+ |   | +||++ ++ +++
NOV20b      197    M---------------DIFLGILLFLLCCPLMVLPCLALILHVECrarrr   231

....kaaktllvvvvvFvlCWlPyfivllldtlc.lsiimsstCelervl
                   +++ |+ +++|+ |+||+++    + |  ++|++++++++
NOV20b      232    qrsaKLNHVILAMVSVFLVSSIYLGIDWFLFWVFqIP------------A   269 ptallvtlwLayvNsclNPiIY<-*        (SEQ ID NO:248)
                   |++ +|| ++ ++||   ||+ |
NOV20b      270    PFPEYVTDLCICINSSAKPIVY  291      (SEQ ID NO:69)
```

Consistent with other known members of the GPCR family of proteins, NOV20 contains 7tm_1 7 transmembrane receptor (rhodopsin family) domain as illustrated in Table 20K and Table 20L, as well as homology and cellular localization, i.e. plasma membrane.

NOV20 nucleic acids, and the encoded polypeptides, according to the invention are useful in a variety of applications and contexts. For example, NOV20 nucleic acids and polypeptides can be used to identify proteins that are members of the GPCR family of proteins. The NOV20 nucleic acids and polypeptides can also be used to screen for molecules, which inhibit or enhance NOV20 activity or function. Specifically, the nucleic acids and polypeptides according to the invention may be used as targets for the identification of small molecules that modulate or inhibit, e.g., cellular signal transduction. These molecules can be used to treat, e.g., cancer, immune disorders, and endocrine disorders.

In addition, various NOV20 nucleic acids and polypeptides according to the invention are useful, inter alia, as novel members of the protein families according to the presence of domains and sequence relatedness to previously described proteins. For example, the NOV20 nucleic acids and their encoded polypeptides include 7tm_1 7 transmembrane receptor (rhodopsin family) domain and sequence homology that are characteristic of proteins belonging to the family of GPCR such as the G protein-coupled receptor (RTA). The GPCR1 protein of the invention has a high homology to the 7tm_1 domain (PFam Acc. No. pfam00001). The 7tm_1 domain is from the 7 transmembrane receptor family, which includes a number of different proteins, including, for example, serotonin receptors, dopamine receptors, histamine receptors, andrenergic receptors, cannabinoid receptors, angiotensin II receptors, chemokine receptors, opioid receptors, G-protein coupled receptor (GPCR) proteins, olfactory receptors (OR), and the like.

G-Protein Coupled Receptor proteins ("GPCRs") have been identified as a large family of G protein-coupled receptors in a number of species. These receptors share a seven transmembrane domain structure with many neurotransmitter and hormone receptors, and are likely to underlie the recognition and G-protein-mediated transduction of various signals. Human GPCR generally do not contain introns and belong to four different gene subfamilies, displaying great sequence variability. These genes are dominantly expressed in olfactory epithelium. See, e.g., Ben-Arie et al., Hum. Mol. Genet. 3:229–235(1994); and, Online Mendelian Inheritance in Man ("OMIM") entry # 164342 (http://www.ncbi.nlm.nih.gov/entrez/dispomim.cgi?).

The NOV20 nucleic acids and polypeptides, antibodies and related compounds according to the invention will be useful in therapeutic and diagnostic applications in the mediation of cellular signal transduction. As such the NOV20 nucleic acids and polypeptides, antibodies and related compounds according to the invention may be used to treat a wide range of disorders such as cancer, immune disorders, endocrine disorders and other diseases, e.g., developmental diseases; MHCII and III diseases (immune diseases); taste and scent detectability disorders; Burkitt's lymphoma; corticoneurogenic disease; signal transduction pathway disorders; metabolic pathway disorders; retinal diseases including those involving photoreception; cell growth rate disorders; cell shape disorders; metabolic disorders; feeding disorders; control of feeding; the metabolic syndrome X; wasting disorders associated with chronic diseases; obesity; potential obesity due to over-eating or metabolic disturbances; potential disorders due to starvation (lack of appetite); diabetes; noninsulin-dependent diabetes mellitus (NIDDM); infectious disease; bacterial, fungal, protozoal and viral infections (particularly infections caused by HIV-1 or HIV-2); pain; cancer (including but not limited to neoplasm; adenocarcinoma; lymphoma; prostate cancer; uterus cancer); cancer-associated cachexia; anorexia;

bulimia; asthma; Parkinson's disease; acute heart failure; hypotension; hypertension; urinary retention; osteoporosis; Crohn's disease; multiple sclerosis; Albright Hereditary Ostoeodystrophy; angina pectoris; myocardial infarction; ulcers; allergies; benign prostatic hypertrophy; and psychotic and neurological disorders; including anxiety; schizophrenia; manic depression; delirium; dementia; neurodegenerative disorders; Alzheimer's disease; severe mental retardation; Dentatorubro-pallidoluysian atrophy (DRPLA); Hypophosphatemic rickets; autosomal dominant (2) Acrocallosal syndrome and dyskinesias, such as Huntington's disease or Gilles de la Tourette syndrome; immune disorders; Adrenoleukodystrophy; Congenital Adrenal Hyperplasia; Hemophilia; Hypercoagulation; Idiopathic thrombocytopenic purpura; autoimmume disease; immunodeficiencies; transplantation; Von Hippel-Lindau (VHL) syndrome; Stroke; Tuberous sclerosis; hypercalceimia; Cerebral palsy; Epilepsy; Lesch-Nyhan syndrome; Ataxia-telangiectasia; Leukodystrophies; Behavioral disorders; Addiction; Neuroprotection; Cirrhosis; Transplantation; Systemic lupus erythematosus; Emphysema; Scleroderma; ARDS; Renal artery stenosis; Interstitial nephritis; Glomerulonephritis; Polycystic kidney disease; Systemic lupus erythematosus; Renal tubular acidosis; IgA nephropathy; Cardiomyopathy; Atherosclerosis; Congenital heart defects; Aortic stenosis; Atrial septal defect (ASD); Atrioventricular (A-V) canal defect; Ductus arteriosus; Pulmonary stenosis; Subaortic stenosis; Ventricular septal defect (VSD); valve diseases; Scleroderma; fertility; Pancreatitis; Endocrine dysfunctions; Growth and reproductive disorders; Inflammatory bowel disease; Diverticular disease; Leukodystrophies; Graft vesus host; Hyperthyroidism; Endometriosis; and hematopoietic disorders.

The NOV20 nucleic acids and polypeptides are useful for detecting specific cell types. For example, expression analysis has demonstrated that a NOV20 nucleic acid is expressed in Brain, Synovium/Synovial membrane.

Additional utilities for NOV20 nucleic acids and polypeptides according to the invention are disclosed herein.

NOV21

A NOV21 polypeptide has been identified as a TFIIIC box B-binding subunit-like protein (also referred to as CG56500-01). The disclosed novel NOV21 nucleic acid (SEQ ID NO:72) of 6921 nucleotides is shown in Table 21A. The cDNA coding for the NOV21 was cloned by polymerase chain reaction (PCR) using the following primers: 5'-CCATGGGCCGACCGGCTC-3' (SEQ ID NO:249) and 5'-TGGCGGGCTTCCTCGTCATC-3' (SEQ ID NO:250) on the following pools of human cDNAs: Pool 1—adrenal gland, bone marrow, brain—amygdala, brain—cerebellum, brain—hippocampus, brain—substantia nigra, brain—thalamus, brain—whole, fetal brain, fetal kidney, fetal liver, fetal lung, heart, kidney, lymphoma—Raji, mammary gland, pancreas, pituitary gland, placenta, prostate, salivary gland, skeletal muscle, small intestine, spinal cord, spleen, stomach, testis, thyroid, trachea, uterus. The novel NOV21 nucleic acid sequences maps to the chromosome16p12.

An ORF begins with an ATG initiation codon at nucleotides 61–63 and ends with a TAG codon at nucleotides 6313–6315. A putative untranslated region and/or downstream from the termination codon is underlined in Table 21A, and the start and stop codons are in bold letters.

TABLE 21A

NOV21 Nucleotide Sequence (SEQ ID NO:72)

ATGGACCAAGGCCCTTGGCGGTGCGTTGCGCACCCCCGGGGCGCCGCGACTGAAGTAGCAATGGACG
CGCTGGAGTCGTTGTTGGACGAAGTCGCTCTGGAGGGGCTCGATGGCCTGTGTCTGCCAGCGCTGTG
GAGCCGGCTGGAGACGCGAGTGCCGCCCTTCCCGCTGCCTTTGGAACCCTGCACGCAGGAGTTTCTC
TGGCGGGCCCTCGCCACGCACCCGGGCATCAGCTTCTATGAGGAGCCTCGGGAGCGACCCGACCTAC
AGCTCCAGGACCGGTATGAAGAAATTGATTTGGAAACTGGAATTTTGGAGTCTAGGAGGGACCCGGT
GGCTTTGGAGGATGTCTACCCCATTCATATGATCTTAGAGAATAAGGATGGCATCCAGGGCTCATGC
CGCTACTTTAAGGAGAGGAAAAACATTACCAATGACATCAGAACCAAGTCCTTGCAGCCTCGCTGTA
CAATGGTGGAACCCTTTGACAGGTGGGGGAAGAAACTGATCATCGGTTCCCTCCCAGCCCATGCGGT
ACAGGCCCTTGATAGCCCAGGAGGGGGATCCCGACCTGAAGCTGCCCGACTTCTCCTACTGCATCCT
GGAACGGCTAGGCCGGTCCAGGTGCAAGGGGAGCTCCAGCGAGACCTTCACACCACTGCTTTCAAGG
TTGATGCTGGGAAGCTGCACTATCACAGAAAAATTTTGAACAAAAACGGGCTGATTACAATGCAGTC
CCATGTGATCCGATTACCCACTGGAGCCCAGCAACACTCAATCCTCCTCCTACTGAACCGGTTTCAT
GTGGACAGGAGGAGCAAATACGACATCCTCATGGAGAAGCTTTCGGTCATGCTGAGCACACGGACTA
ACCACATAGAGACGCTGGGAAAGCTGAGGGAAGAGCTGGGGCTGTGCGAAAGGACGTTTAAGCGTCT
GTACCAGTATATGCTGAACGCCGGGCTAGCCAAGGTGGTGTCTCTTCGCTTGCAAGAGATCCACCCT
GAATGTGGACCTTGTAAGACAAAGAAAGGGACCGACGTCATGGTTCGGTGCCTCAAGCTGCTGAAGG
AATTTAAACGGAATGACCATGATGATGACGAGGACGAGGAGGTCATCTCCAAGACAGTGCCTCCAGT
GGACATTGTGTTCGAGCGGGATATGCTCACACAGACCTACGACCTCATTGAGCGCAGAGGCACGAAA
GGAATTTCCCAAGCTGAAATCCGAGTGGCTATGAATGTGGGAAAACTAGAAGCAAGAATGCTGTGCC
GACTTCTTCAAAGATTCAAAGTTGTCAAGGGATTCATGGAAGACGAAGGTCGGCAGCGAACCACCAA
GTACATTTCCTGCGTGTTTGCAGAGGAGAGCGACCTAAGCCGGCAGTACCAAAGAGAGAAGGCCCGC
AGCGAGCTCTTGACCACCGTGAGCCTGGCGTCTATGCAGGAGGAGTCGCTTCTGCCTGAAGGCGAGG
ACACCTTCCTCTCTGAGTCGGACAGTGAGGAGGAGAGGAGCAGCAGCAAGCGGAGAGGCAGAGGGTC
CCAGAAAGACACAAGAGCCTCTGCAAACCTCCGGCCCAAGACCCAGCCTCATCACTCCACCCCAACC
AAGGGTGGGTGGAAAGTTGTAAACCTACACCCATTGAAAAAGCAGCCGCCCTCCTTCCCAGGAGCTG
CTGAAGAGAGAGGCCTGCCAGAGCCTTGCCAGCAGGGACAGCCTCTTAGATACCAGCAGGCGTCTCAGA
ACCCAACGTGTCCTTTGTCTCCCACTGTGCGGACAGCAACAGTGGTGACATAGCTGTGATCGAGGAG
GTCCGGATGGAAAACCCAAAGGAGAGTAGCAGTTCCTGAAGACTGGGAGGCACAGCTCAGGCCAAG
ACAAACCACACGAAACTTACCGACTGCTGAAACGCAGGAATCTGATCATAGAAGCTGTCACCAATCT
TCGCTTAATCAGAGAGTTTATTCACGATTCAGAAGATGATCATGGATCAGGAGAAGCAGGAAGGCGTG
TCCACCAAGTGCTGCAAGAAGTCCATTGTCCGCTTGGTGCGGAACCTGTCTGAGGAAGGTCTCTTGC
GATTGTATCGGACCACTGTCATTCAAGATGGCATCAAGAAGAAGGTGGATCTGGTGGTGCACCCGTC
CATGGACCAGAACGACCCTCTAGTGAAGTGCCATCGAGCAGGTCCGCTTCCGGATCTCCAATTCA
AGCACAGCCAACAGGGTTAAAACTTCCCAGCCTCCAGTGCCCCAAGGGGAGGCAGAAGAAGACAGTC
AAGGAAAAGAGGGCCCAAGTGGATCAGGGGACTCTCAGCTGAGTGCTTCCTCTAGATCAGAAAGTGG

TABLE 21A-continued

NOV21 Nucleotide Sequence (SEQ ID NO:72)

ACGGATGAAAAAAAGTGATAATAAAATGGGCATAACCCCGCTTAGAAATTATCACCCCATTGTAGTT
CCCGGACTGGGGCGTTCTCTAGGATTTCTGCCCAAAATGCCTCGCCTGCGGGTGGTCCACATGTTTC
TGTGGTACCTCATCTACGGGCACCCTGCCAGCAACACCGTGGAGAAGCCAAGCTTCATCAGTGAACG
GAGAACGATAAAGCAGGAGTCAGGCAGGGCAGGCGTCCGGCCGTCCTCCTCTGGAAGTGCCTGGGAG
GCCTGCTCTGAAGCCCCATCTAAAGGCAGCCAAGATGGTGTCACCTGGGAGGCTGAAGTGGAGCTTG
CCACGGAGACAGTGTATGTCGACGATGCCTCGTGGATGCGCTACATCCCCCCAATCCCAGTCCACAG
GGACTTCGGCTTTGGCTGGGCTCTCGTCAGCGACATCCTCCTCTGCCTTCCCCTCTCCATCTTCATC
CAGATTGTGCAAGTCAGCTACAAGGTGGACAACCTGGAGGAATTTCTGAACGACCCGCTGAAGAAGC
ACACGCTGATCCGCTTTCTCCCCAGGCCCATTCGGCAGCAGCTTCTGTACAAGAGGCGTTACATTTT
TTCGGTGGTGGAGAACCTTCAGAGGCTGTGCTACATGGGGGGTGCTACAGTTTGGTCCCACGGAAAAG
TTTCAGGATAAAGATCAGGTCTTTATCTTCTTGAAGAAGAATGCAGTCATTGTTGACACTACCATCT
GCGACCCACATTACAACCTGGGCCGCAGGAGGCGGCCCTTCGAGAGGCGCCTCTATGTCCTGAACTC
AATGCAGGATGTGGAAAACTACTGGTTTGACCTGCAGTGCGTCTGCCTCAACACCCCACTAGGCGTG
GTGCGCTGCCCGCGCGTCAGGAAGAACAGCAGCACAGACCAGGGCAGCGACGAGGAGGGCAGCCTGC
AGAAGGAGCAGGAGAGCGCCATGGACAAGCACAACCTGGAGCGCAAGTGCGCCATGCTGGAGTACAC
CACTGGAAGCCGTGAGGTGGTGGATGAAGGCTTGATCCCTGGAGATGGGCTGGGTGCCGCAGGGCTC
GATTCCAGCTTCTACGGACACCTCAAGCGCAACTGGATCTGGACCAGCTACATCATCAACCAGGCCA
AAAAGGAGAACACTGCCGCAGAGAATGGACTCACAGTGAGGCTCCAGACATTTCTGTCCAAGCGCCC
AATGCCCCTCAGTGCCAGAGGCAACAGCAGGTTGAATATTTGGGGGGAAGCAAGAGTAGGCTCCGAG
CTCTGTGCTGGCTGGGAAGAGCAGTTTGAGGTGGACCGAGAGCCCTCGCTGGACCGAAACCGGAGAG
TGAGGGGTGGGAAAAGCCAGAAGCGGAAGCGGCTGAAGAAGGACCCTGGGAAGAAGATCAAGAGAAA
GAAGAAAGGAGAGTTCCCAGGAGAAAAAAGCAAAAGGCTGCGCTACCATGATGAAGCCGACCAGAGT
GCCCTGCATCGGATGACGCGGCTTCGTGTCACCTGGTCTATGCAGGAGGATGGGCTGCTTGTGCTGT
GCCGCATTGCCAGCAATGTCCTCAACACCAAGGTGAAGGGTCCATTTGTCACCTGGCAGGTGGTACG
GGACATTTTGCATGCCACGTTTGAAGAGTCTTTGGATAAAACATCTCATTCCCTTGGACGAAGAGCT
CGCTACATAGTCAAAAACCCACAGGCCTATCTCAACTATAAAGTGTGCCTGGCCGAGGTGTACCAGG
ATAAAGCACTTGTTGGAGATTTCATGAATCGAAGAGGTGACTATGATGACCCAAAGGTTTGTGCCAA
CGAGTTTAAAGAATTTGTGGAGAAGCTTAAAGAAAAGTTCAGTTCAGCCCTAAGGAATTCTAACCTT
GAAATCCCAGACACACTCCAGGAGCTGTTCGCCAGGTACCGAGTTTTGGCAATTGGGGATGAAAAAG
ATCAAACCAGGAAAGAGGATGAACTTAACAGCGTGGATGACATCCACTTTCTGGTGCTTCAGAACCT
GATCCAGAGCACGCTGGCCCTCTCAGACAGTCAGATGAAGTCCTACCAGTCATTCCAGACTTTCCGC
CTCTATCGGGAGTACAAGGACCACGTTCTTGTGAAGGCCTTCATGGAGTGCCAGAAGAGGAGCTTGG
TCAACCGGCGCCGGGTCAACCACACGCTGGGCCCCAAGAAGAACCGGGCCCTCCCCTTCGTGCCAAT
GTCCTACCAGCTATCCCAGACCTACTACAGGATTTTTACGTGGCGATTTCCAAGCACCATCTGCACG
GAGTCATTCCAGTTTTTGGACAGAATGCGGGCTGCCGGCAAGTTGGACCAGCCTGATCGTTTCTCTT
TCAAAGACCAGGATAATAACGAGCCCACAAACGACATGGTGGCCTTTTCACTGGACGGCCCTGGAGG
AAATTGTGTGGCCGTCCTGACCCTCTTCTCTCTGGGCCTCATTTCTGTGGATGTCAGGATCCCGGAG
CAGATCATCGTGGTAGACAGCTCAATGGTGGAGAATGAGGTCATCAAAAGCTTGGGGAAGGACGGCA
GCCTGGAAGGATGACGAGGATGAAGAGGATGACTTGGACGAAGGTGTAGGGGGCAAGCGCCGGAGCAT
GGAGGTGAAACCTGCGCAAGCCTCCCACACCAACTACCTGCTGATGAGGGGCTACTACTCCCCCGGC
ATCGTCAGCACCCGCAACCTCAACCCCAACGACAGCATTGTGGTCAACTCCTGCCAGATGAAGTTCC
AGCTCCGCTGCACCCCTGTGCCCGCCCGGCTCAGGCCCGCTGCCGCTCCTCTGGAAGAGCTAACAAT
GGGAACCTCCTGCCTCCCTGATACGTTCACCAAGCTGATAAACCCCCAGGAAAACACCTGCAGCTTG
GAGGAGTTTGTCCTCCAGCTGGAGCTGTCTGGGTATAGTCCCGAAGACCTGACTGCTGCCTTGGAGA
TCTTGGAAGCCATTATAGCCACGGGTTGTTTTGGGATTGACAAGGAGGAGCTGCGCAGACGGTTCTC
GGCCTTGGAGAAGGCAGGTGGTGGGCGCACCAGGACATTCGCAGATTGCATCCAGGCCCTCCTGGAG
CAGCATCAGGTGCTGGAGGTCGGTGGCAACACTGCGCGCCTGGTAGCCATGGGCTCTGCCTGGCCTT
GGCTCCTGCACTCCGTGCGGCTGAAAGACAGAGAAGACGCCGACATCCAGAGAGAAGACCCCCAGGC
CAGACCCCTGGAGGGGTCTTCCAGTGAGGACAGCCCCCCGAGGGGCAGGCACCTCCTTCTCACAGC
CCCCGGGGCACCAAGAGGCGCGCCAGCTGGGCCAGTGAGAATGGGGAGACCGACGCCGAGGGCACCC
AGATGACCCCTGCCAAGAGGCCAGCGCTCCAGGACTCAAATTTGGCCCCCAGCCTTGGGCCCGGAGC
TGAAGATGGGGCAGAAGCCCAGGCCCCATCTCCACCCCCAGCTCTTGAAGACACCGCTGCAGCGGGA
GCAGCACAGGAAGACCAAGAGGGTGTCGGGTTCACAGAGAGTTTCGGAGCTGCCAACATCTCCCAGG
CAGCACGGGAAAGGGACTGTGAGAGTGTCTGCTTCATCGGCCGGCCGTGGCGTGTCGTGGATGGCCA
CCTGAACCTTCCTGTATGCAAGGGTATGATGGAGGCCATGCTGTACCACATCATGACCAGGCCTGGC
ATCCCCGAGAGCTCCCTGCTGCGCCACTACCAGGGGGTCCTGCAGCCCGTCGCCGTGCTGGAGTTGC
TCCAGGGCCTGGAGTCCCTCGGCTGCATCCGGAAGCGCTGGCTGAGAAAGCCAAGGCCTGTCTCGCT
CTTCTCTACACCCGTGGTGGAAGAGGTGGAAGTGCCCTCCAGCCTGGACGAGAGCCCCATGGCTTTC
TATGAGCCCACCTTGGACTGTACCCTCCGGCTGGGCCGTGTGTTCCCCCACGAGGTCAACTGGAACA
AGTGGATCCACCTCTAGGACCCCTGTGGGCGTCCCCTCCCTCCCAGCCACCGCCTGCCACACCACTC
CTGCCTGGTGCTCGGCAGACCCCACTGTGCCCTGGCCTTGGGTCTGCCGAGCCTCCTGCAGCAGGGG
ACGGGTGCTTTGGCCAGAGTCACAGACTGACACGTTTCCCACTGTACTGGAACTCTGGAAAGAGGGG
CTCCCCGACCTGCCCATCCCCCAGGCTCTTCTGGGCCTTCCCCTTGGGAACTGGCCTCATCACACTG
GGAGTTGGTGCTTCTTGTCTCTGGGTCTCCAGAGTTTGCCCCGCCTGCACACCTCACATTCCAGA
CTCTAGCCATCTCGGCAGGATCTCCTGGCTCCTTGAGTGCCCAGGTGCCACCAAGAGGAAGGGCCTT
GTGGGATACACCTTGCAGAATAGGGATCGGTGTGCCCCGCTGCGAGGGGCCCCCCATGGGGGCTGTG
GCCCCTCCGCAGGCAGGACATCCCAACCCCTGGCTGGGACTGAACCACCCAGAGCGGAGCGGCTCCC
TTTTCAGCCTTGTGAGTCACCTGGCAGGCCCCAGCTGGGCTGGCTGTCCGTGTCCCTCAGCCTGGCT
GGTGATTCCTTGCAGGAGGG

The NOV21 protein (SEQ ID NO:73) encoded by SEQ ID NO:72 is 2084 amino acid residues in length and is presented using the one-letter amino acid code in Table 21B. NOV21 has two SNP variants, whose variant positions for its nucleotide and amino acid sequences is numbered according to SEQ ID NOS:72 and 73, respectively. A variant sequence can include a single nucleotide polymorphism (SNP). A SNP can, in some instances, be referred to as a "cSNP" to denote that the nucleotide sequence containing the SNP originates as a cDNA.

NOV21 has at least two variants. Variant 13376755 is a G to A SNP at 129 bp of the nucleotide sequence that results in no change in the protein sequence (silent), and variant c100.2613 is an insertion of nucleotide C before 5780 bp of the nucleotide sequence that results in a frameshift with all amino acids after 1907 being discordant with the original protein sequence.

Psort analysis predicts the NOV21 protein of the invention to be localized in the nucleus with a certainty of 0.8000, as expected by a transcription factor subunit. As expected for a member of the TFIIIC box B-binding subunit protein family, no identifiable domains with significant score were identified in the NOV21 polypeptide by searches using algorithms such as PROSITE, Blocks, Pfam, ProDomain, Prints.

TABLE 21B

Encoded NOV21 protein sequence (SEQ ID NO:73)

MDALESLLDEVALEGLDGLCLPALWSRLETRVPPFPLPLEPCTQEFLWRALATHPGISFYEEPRERPDLQLQD
RYEEIDLETGILESRRDPVALEDVYPIHMILENKDGIQGSCRYFKERKNITNDIRTKSLQPRCTMVEPFDRWG
KKLIIGSLPAHAVQALDSPGGGSRPEAARLLLLHPGTARPVQVQGELQRDLHTTAFKVDAGKLHYHRKILNKN
GLITMQSHVIRLPTGAQQHSILLLLNRFHVDRRSKYDILMEKLSVMLSTRTNHIETLGKLREELGLCERTFKR
LYQYMLNAGLAKVVSLRLQEIHPECGPCKTKKGTDVMVRCLKLLKEFKRNDHDDDEDEEVISKTVPPVDIVFE
RDMLTQTYDLIERRGTKGISQAEIRVAMNVGKLEARMLCRLLQRFKVVKGFMEDEGRQRTTKYISCVFAEESD
LSRQYQREKARSELLTTVSLASMQEESLLPEGEDTFLSESDSEEERSSSKRRGRGSQKDTRASANLRPKTQPH
HSTPTKGGWKVVNLHPLKKQPPSFPGAAEERACQSLASRDSLLDTSSVSEPNVSFVSHCADSNSGDIAVIEEV
RMENPKESSSSLKTGRHSSGQDKPHETYRLLKRRNLIIEAVTNLRLIESLFTIQKMIMDQEKQEGVSTKCCKK
SIVRLVRNLSEEGLLRLYRTTVIQDGIKKKVDLVVEPSMDQNDPLVRSAIEQVRFRISNSSTANRVKTSQPPV
PQGEAEEDSQGKEGPSGSGDSQLSASSRSESGRMKKSDNKMGITPLRNYHPIVVPGLGRSLGFLPKMPRLRVV
HMFLWYLIYGHPASNTVEKPSFISERRTIKQESGRAGVRPSSSGSAWEACSEAPSKGSQDGVTWEAEVELATE
TVYVDDASWMRYIPPIPVHRDFGFGWALVSDILLCLPLSIFIQIVQVSVKVDNLEEFLNDPLKKHTLIRFLPR
PIRQQLLYKRRYIFSVVENLQRLCYMGVLQFGPTEKFQDKDQVFIFLKKNAVIVDTTICDPHYNLGRRRRPFE
RRLYVLNSMQDVENYWFDLQCVCLNTPLGVVRCPRVRKNSSTDQGSDEEGSLQKEQESAMDKHNLERKCAMLE
YTTGSREVVDEGLIPGDGLGAAGLDSSFYGHLKRNWIWTSYIINQAKKENTAAENGLTVRLQTFLSKRPMPLS
ARGNSRLNIWGEARVGSELCAGWEEQFEVDREPSLDRNRRVRGGKSQKRKRLKKDPGKKIKRKKKGEFPGEKS
KRLRYHDEADQSALHRMTRLRVTWSMQEDGLLVLCRIASNVLNTKVKGPFVTWQVVRDILHATFEESLDKTSH
SLGRRARYIVKNPQAYLNYKVCLAEVYQDKALVGDFMNRRGDYDDPKVCANEFKEFVEKLKEKFSSALRNSNL
EIPDTLQELFARYRVLAIGDEKDQTRKEDELNSVDDIHFLVLQNLIQSTLALSDSQMKSYQSFQTFRLYREYK
DHVLVKAFMECQKRSLVNRRRVNHTLGPKKNRALPFVPMSYQLSQTYYRIFTWRFPSTICTESFQFLDRMRAA
GKLDQPDRFSFKDQDNNEPTNDMVAFSLDGPGGNCVAVLTLFSLGLISVDVRIPEQIIVVDSSMVENEVIKSL
GKDGSLEDDEDEEDDLDEGVGGKRRSMEVKPAQASHTNYLLMRGYYSPGIVSTRNLNPNDSIVVNSCQMKFQL
RCTPVPARLRPAAAPLEELTMGTSCLPDTFTKLINPQENTCSLEEFVLQLELSGYSPEDLTAALEILEAIIAT
GCFGIDKEELRRRFSALEKAGGGRTRTFADCIQALLEQHQVLEVGGNTARLVAMGSAWPWLLHSVRLKDREDA
DIQREDPQARPLEGSSSEDSPPEGQAPPSHSPRGTKRRASWASENGETDAEGTQMTPAKRPALQDSNLAPSLG
PGAEDGAEAQAPSPPPALEDTAAAGAAQEDQEGVGFTESFGAANISQAARERDCESVCFIGRPWRVVDGHLNL
PVCKGMMEAMLYHIMTRPGIPESSLLRHYQGVLQPVAVLELLQGLESLGCIRKRWLRKPRPVSLFSTPVVEEV
EVPSSLDESPMAFYEPTLDCTLRLGRVFPHEVNWNKWIHL

A search against the Patp database, a proprietary database that contains sequences published in patents and patent publications, yielded several homologous proteins shown in Table 21C.

TABLE 21C

Patp results for NOV21

| Sequences producing High-scoring Segment Pairs: | Reading Frame | High Score | Smallest Sum Prob P (N) |
|---|---|---|---|
| >patp:AAM32653 Peptide #6690 encoded by probe | +1 | 519 | 5.2e-48 |
| >patp:AAM59814 Human brain expressed single exon probe | +1 | 519 | 5.2e-48 |
| >patp:AAM72401 Human bone marrow expressed probe | +1 | 519 | 5.2e-45 |
| >patp:AAM34175 Peptide #8212 encoded by probe | +1 | 491 | 4.9e-48 |
| >patp:AAM74000 Human bone marrow expressed probe | +1 | 491 | 4.9e-48 |
| >patp:AAM60401 Human brain expressed single exon probe | +1 | 343 | 2.7e-29 |
| >patp:AAM73037 Human bone marrow expressed probe | +1 | 343 | 2.7e-29 |
| >patp:AAM33554 Peptide #7591 encoded by probe | +1 | 324 | 2.8e-27 |
| >patp:AAM60680 Human brain expressed single exon probe | +1 | 324 | 2.8e-27 |
| >patp:AAM73352 Human bone marrow expressed probe | +1 | 324 | 2.8e-27 |

In a BLAST search of public sequence databases, it was found, for example, that the nucleic acid sequence of this invention has 6006 of 6134 bases (97%) identical to a gb:GENBANK-ID:HSU02619|acc:U02619.1 mRNA from *Homo sapiens* (Human TFIIIC Box B-binding subunit mRNA, complete cds). The NOV21 polypeptide was found to have 1937 of 1948 amino acid residues (99%) identical to, and 1939 of 1948 amino acid residues (99%) similar to, the 2109 amino acid residue ptnr:SPTREMBL-ACC:Q12789 protein from *Homo sapiens* (TFIIIC BOX B-BINDING SUBUNIT (TRANSCRIPTION FACTOR (TFIIIC) ALPHA CHAIN) (3' PARTIAL)). The NOV21 polypeptide lacks 25 internal amino acids, when compared to ptnr:SPTREMBL-ACC:Q12789 protein from *Homo sapiens* (Human) (TFIIIC BOX B-BINDING SUBUNIT (TRANSCRIPTION FACTOR (TFIIIC) ALPHA CHAIN) (3' PARTIAL)).

NOV21 also has homology to the proteins shown in the BLASTP data in Table 21D.

TABLE 21D

BLAST results for NOV21

| Gene Index/ Identifier | Protein/Organism | Length (aa) | Identity (%) | Positives (%) | Expect |
| --- | --- | --- | --- | --- | --- |
| ptnr:SPTREMBL-ACC:Q12789 | TFIIIC BOX B-BINDING SUBUNIT (TRANSCRIPTION FACTOR (TFIIIC) ALPHA CHAIN) (3' PARTIAL) - *Homo sapiens* | 2109 | 1937/1948 (99%) | 1939/1948 (99%) | 0.0 |
| ptnr:SPTREMBL-ACC:Q9Y4W9 | TRANSCRIPTION FACTOR (TFIIIC) ALPHA CHAIN, PARTIAL - *Homo sapiens* | 1857 | 1679/1696 (98%) | 1683/1696 (99%) | 0.0 |
| ptnr:SPTREMBL-ACC:Q63505 | TRANSCRIPTION FACTOR IIIC ALPHA-SUBUNIT - *Rattus norvegicus* | 2148 | 1506/1933 (77%) | 1669/1933 (86%) | 0.0 |
| ptnr:SPTREMBL-ACC:Q12838 | TFIIIC ALPHA SUBUNIT - *Homo sapiens* | 660 | 627/658 (95%) | 633/658 (96%) | 0.0 |
| ptnr:pir-id:B56011 | Transcription factor IIIC alpha chain - *Homo sapiens* | 654 | 623/654 (95%) | 629/654 (96%) | 0.0 |

A multiple sequence alignment is given in Table 21E, with the NOV21 protein being shown on line 1 in Table 21E in a ClustalW analysis, and comparing the NOV21 protein with the related protein sequences shown in Table 21D. This BLASTP data is displayed graphically in the ClustalW in Table 21E.

Table 21E. ClustalW Analysis of NOV21

1) > NOV21; SEQ ID NO:73
2) >Q12789/ TFIIIC BOX B-BINDING SUBUNIT (TRANSCRIPTION FACTOR (TFIIIC) ALPHA CHAIN) (3' PARTIAL) [*Homo sapiens*]; SEQ ID NO:251
3) >Q9Y4W9/ TRANSCRIPTION FACTOR (TFIIIC) ALPHA CHAIN, PARTIAL [*Homo sapiens*]; SEQ ID NO:252
4) >Q63505/ TRANSCRIPTION FACTOR IIIC ALPHA-SUBUNIT [*Rattus norvegicus*]; SEQ ID NO:253
5) >Q123838 / TFIIIC ALPHA SUBUNIT [*Homo sapiens*]; SEQ ID NO:254
6) >O13129/ Transcription factor IIIC alpha chain [*Homo sapiens*]; SEQ ID NO:255

```
                        10        20        30        40        50
                ....|....|....|....|....|....|....|....|....|....|
        NOV21   MDALESLLDEVALEGLDGLCLPALWSRLETRVPPFPLPLEPCTQEFLWRA
        Q12789  MDALESLLDEVALEGLDGLCLPALWSRLETRVPPFPLPLEPCTQEFLWRA
        Q9Y4W9  --------------------------------------------------
        Q63505  MDALESLLDEVALEGLDGLCLPALWSRLESRSPAFPLPLEPYTQEFLWRA
        Q12838  --------------------------------------------------
        B56011  --------------------------------------------------

60        70        80        90       100
                ....|....|....|....|....|....|....|....|....|....|
        NOV21   LATHPGISFYEEPRERPDLQLQDRYEEIDLETGILESRRDPVALEDVYPI
        Q12789  LATHPGISFYEEPRERPDLQLQDRYEEIDLETGILESRRDPVALEDVYPI
        Q9Y4W9  --------------------------------------------------
        Q63505  LVTHPGISFYEEPRERPDLQLQDRYEEIDLETGILESRRDPVTLEDVYPI
        Q12838  ------------------NSLQDRYEEIDLETGILESRRDPVALEDVYPI
        B56011  --------------------LQDRYEEIDLETGILESRRDPVALEDVYPI 110       120       130       140       150
                ....|....|....|....|....|....|....|....|....|....|
        NOV21   HMILENKDGIQGSCRYFKERKNITNDIRTKSLQPRCTMVEPFDRWGKKLI
        Q12789  HMILENKDGIQGSCRYFKERKNITNDIRTKSLQPRCTMVEPFDRWGKKLI
```

```
            Q9Y4W9    ------------------------------------------
            Q63505    HMILENKDGIQGSCRYFKERKDITSSIRSKCLQPRCTMVEAFSRWGKKLI
            Q12838    HMILENKDGIQGSCRYFKERKNITNDIRTKSLQPRCTMVEAFDRWGKKLI
            B56011    HMILENKDGIQGSCRYFKERKNITNDIRTKSLQPRCTMVEAFDRWGKKLI 160       170       180       190       200
                         ....|....|....|....|....|....|....|....|....|....|
            NOV21     IGSLPAHAVQALDSPGGSRPEAARLLLLHPGTARPVQVQGELQRDLHTT
            Q12789    IGSLPAHAVQALDSPGGSRPEAARLLLLHPGTARPVQVQGELQRDLHTT
            Q9Y4W9    ------------------------------------------
            Q63505    IVASQDMRYRALIGLEGDPDLKLPDFSYCILERLGRSRWQGELQRDLHTT
            Q12838    IVASQAMRYRALIGQEGDPDLKLPDFSYCILERLGRSRWQGELQRDLHTT
            B56011    IVASQAMRYRALIGQEGDPDLKLPDFSYCILERLGRSRWQGELQRDLHTT 210       220       230       240       250
                         ....|....|....|....|....|....|....|....|....|....|
            NOV21     AFKVDAGKLHYHRKILNKNGLITMQSHVIRLPTGAQQHSILLLLNRFHVD
            Q12789    AFKVDAGKLHYHRKILNKNGLITMQSHVIRLPTGAQQHSILLLLNRFHVD
            Q9Y4W9    ------------------------------------------
            Q63505    AFKVDAGKLHYHRKILNKNGLITMQSHVIRLPTGAQQHSILLLLNRFHVD
            Q12838    AFKVDAGKLHYHRKILNKNGLITMQSHVIRLPTGAQQHSILLLLNRFHVD
            B56011    AFKVDAGKLHYHRKILNKNGLITMQSHVIRLPTGAQQHSILLLLNRFHVD 260       270       280       290       300
                         ....|....|....|....|....|....|....|....|....|....|
            NOV21     RRSKYDILMEKLSVMLSTRTNHIETLGKLREELGLCERTFKRLYQYMLNA
            Q12789    RRSKYDILMEKLSVMLSTRTNHIETLGKLREELGLCERTFKRLYQYMLNA
            Q9Y4W9    --SKYDILMEKLSVMLSTRTNHIETLGKLREELGLCERTFKRLYQYMLNA
            Q63505    RRSKYDILMEKLSMMLSTRSNQIETLGKLREELGLCERTFKRLYQYMLNA
            Q12838    RRSKYDILMEKLSVMLSTRTNHIETLGKLREELGLCERTFKRLYQYMLNA
            B56011    RRSKYDILMEKLSVMLSTRTNHIETLGKLREELGLCERTFKRLYQYMLNA 310       320       330       340       350
                         ....|....|....|....|....|....|....|....|....|....|
            NOV21     GLAKVVSLRLQEIHPECGPCKTKKGTDVMVRCLKLLKEFKR---NDHDDD
            Q12789    GLAKVVSLRLQEIHPECGPCKTKKGTDVMVRCLKLLKEFKR---NDHDDD
            Q9Y4W9    GLAKVVSLRLQEIHPECGPCKTKKGTDVMVRCLKLLKEFKR---NDHDDD
            Q63505    GLAKVVSLPLQEIHPECGPCKTKKGTDVMVRCLKLLKEFRRKMEDDHDDD
            Q12838    GLAKVVSLRLQEIHPECGPCKTKKGTDVMVRCLKLLKEFKR---NDHDDD
            B56011    GLAKVVSLRLQEIHPECGPCKTKKGTDVMVRCLKLLKEFKR---NDHDDD 360       370       380       390       400
                         ....|....|....|....|....|....|....|....|....|....|
            NOV21     EDEEVISKTVPPVDIVFERDMLTQTYDLIERRGTKGISQAEIRVAMNVGK
            Q12789    EDEEVISKTVPPVDIVFERDMLTQTYDLIERRGTKGISQAEIRVAMNVGK
            Q9Y4W9    EDEEVISKTVPPVDIVFERDMLTQTYDLIERRGTKGISQAEIRVAMNVGK
            Q63505    DDEEAISKAVPPVDIVFERDMLTQTYELIERRGTKGISQAEIRVAMNVGK
            Q12838    EDEEVISKTVPPVDIVFERDMLTQTYDLIERRGTKGISQAEIRVAMNVGK
            B56011    EDEEVISKTVPPVDIVFERDMLTQTYDLIERRGTKGISQAEIRVAMNVGK 410       420       430       440       450
                         ....|....|....|....|....|....|....|....|....|....|
            NOV21     LEARMLCRLLQRFKVVKGFMEDEGRQRTTKYISCVFAEESDLSRQYQREK
            Q12789    LEARMLCRLLQRFKVVKGFMEDEGRQRTTKYISCVFAEESDLSRQYQREK
            Q9Y4W9    LEARMLCRLLQRFKVVKGFMEDEGRQRTTKYISCVFAEESDLSRQYQREK
            Q63505    LEARMLCRLLQRFKVVKGFMEDEGRQRTTKYISCVFAEESDLSRQYAREK
            Q12838    LEARMLCRLLQRFKVVKGFMEDEGRQRTTKYISCVFAEESDLSRQYQREK
            B56011    LEARMLCRLLQRFKVVKGFMEDEGRQRTTKYISCVFAEESDLSRQYQREK 460       470       480       490       500
                         ....|....|....|....|....|....|....|....|....|....|
            NOV21     ARSELLTTVSLASMQEESLLPEGEDTFLSESDSEEERSSS-KRRGRGSQK
            Q12789    ARSELLTTVSLASMQEESLLPEGEDTFLSESDSEEERSSS-KRRGRGSQK
```

```
          Q9Y4W9    ARSELLTTVSLASMQEESLLPEGEDTFLSESDSEEERSSS-KRRGRGSQK
          Q63505    ARGELLTTVSLASVQDESLMPEGEEAFLSDSESEEESSCSGKRRGRGSRG
          Q12838    ARSELLTTVSLASMQEESLLPEGEDTFLSESDSEEERSSS-KRRGRGSQK
          B56011    ARSELLTTVSLASMQEESLLPEGEDTFLSESDSEEERSSS-KRRGRGSQK 510       520       530       540       550
                        ....|....|....|....|....|....|....|....|....|....|
          NOV21     DTRASANLRPKTQPHHSTPTKGGWKVVNLHPLKKQPPSFPGAAEERACQS
          Q12789    DTRASANLRPKTQPHHSTPTKGGWKVVNLHPLKKQPPSFPGAAEERACQS
          Q9Y4W9    DTRASANLRPKTQPHHSTPTKGGWKVVNLHPLKKQPPSFPGAAEERACQS
          Q63505    HSRASGDACPGSRPHHSTPAKGGWKVLNLHPLKKPKS----AAVERSRRS
          Q12838    DTRASANLRPKTQPHHSTPTKGGWKVVNLHPLKKQPPSFPGAAEERACQS
          B56011    DTRASANLRPKTQPHHSTPTKGGWKVVNLHPLKKQPPSFPGAAEERACQS 560       570       580       590       600
                        ....|....|....|....|....|....|....|....|....|....|
          NOV21     LASRDSLLDTSSVSEPNVSFVSHCADSNSGDIAVIEEVRMENPKESSSSL
          Q12789    LASRDSLLDTSSVSEPNVSFVSHCADSNSGDIAVIEEVRMENPKESSSSL
          Q9Y4W9    LASRDSLLDTSSVSEPNVSFVSHCADSNSGDIAVIEEVRMENPKESSSSL
          Q63505    SACRDG-LDTSSSSELNIPFDPHSMDSHSGDIAVIEEVRLDNPKEGGGSQ
          Q12838    LASRDSLLDTSSVSEPNVSFVSHCADSNSGDIAVIEEVRMENPKESSSSL
          B56011    LASRDSLLDTSSVSEPNVSFVSHCADSNSGDIAVIEEVRMENPKESSSSL 610       620       630       640       650
                        ....|....|....|....|....|....|....|....|....|....|
          NOV21     KTGRHSSGQDKPHETYRLLKRRNLIIEAVTNLRLIESLFTIQKMIMDQEK
          Q12789    KTGRHSSGQDKPHETYRLLKRRNLIIEAVTNLRLIESLFTIQKMIMDQEK
          Q9Y4W9    KTGRHSSGQDKPHETYRLLKRRNLIIEAVTNLRLIESLFTIQKMIMDQEK
          Q63505    KGGRHGSGQDKPHKTYRLLKRRNLIIEAVTNLRLIESLFTIQKMIMDQEK
          Q12838    KTGRHSSGQDKPHETYRLLKRRNLIIEAVTNLRLIESLFTIQKMIMDQEK
          B56011    KTGRHSSGQDKPHETYRLLKRRNLIIEAVTNLRLIESLFTIQKMIMDQEK 660       670       680       690       700
                        ....|....|....|....|....|....|....|....|....|....|
          NOV21     QEGVSTKCCKKSIVRLVRNLSEEGLLRLYRTTVIQDGIKKKVDLVVHPSM
          Q12789    QEGVSTKCCKKSIVRLVRNLSEEGLLRLYRTTVIQDGIKKKVDLVVHPSM
          Q9Y4W9    QEGVSTKCCKKSIVRLVRNLSEEGLLRLYRTTVIQDGIKKKVDLVVHPSM
          Q63505    QEGVSTKCCKKSITRLVRNLSEEGLLRLYRTTVIQDGIKKKVDLVVHPSM
          Q12838    QEGVSTKCCKKSIVRLVRNLSEEGLLRLYRTTVIQDGIKKKVDLVVHPSM
          B56011    QEGVSTKCCKKSIVRLVRNLSEEGLLRLYRTTVIQDGIKKKVDLVVHPSM 710       720       730       740       750
                        ....|....|....|....|....|....|....|....|....|....|
          NOV21     DQNDPLVRSAIEQVRFRISNSSTANRVKTSQPPVPQGEAEEDSQGKEGPS
          Q12789    DQNDPLVRSAIEQVRFRISNSSTANRVKTSQPPVPQGEAEEDSQGKEGPS
          Q9Y4W9    DQNDPLVRSAIEQVRFRISNSSTANRVKTSQPPMVPQGEAEEDSQGKEGPS
          Q63505    DQNDPLVRSAIEQVRFRISNSSTANRVKVPPAPAPQEEAEEGNQEPEVPS
          Q12838    DQNDPLVRSAIEQVRFRISNSSTANRVKT---------------------
          B56011    DQNDPLVRSAIEQVRFRISNSSTANRVK----------------------

760       770       780       790       800
                        ....|....|....|....|....|....|....|....|....|....|
          NOV21     GSGDSQLSASSRSESGRMKKSDNKMGITPLRNYHPIVVPGLGRSLGFLPK
          Q12789    GSGDSQLSASSRSESGRMKKSDNKMGITPLRNYHPIVVPGLGRSLGFLPK
          Q9Y4W9    GSGDSQLSASSRSESGRMKKSDNKMGITPLRNYHPIVVPGLGRSLGFLPK
          Q63505    RSADSEANTSSKPESTRVKKTDEKMGITPLKNYKPVIVPGLGRSIGFLPK
          Q12838    ---------SQP--------------------------------------
          B56011    --------------------------------------------------

810       820       830       840       850
                        ....|....|....|....|....|....|....|....|....|....|
          NOV21     MPRLRVVHMFLWYLIYGHPASNTVEKPSFISERRTIKQESGRAGVRPSSS
          Q12789    MPRLRVVHMFLWYLIYGHPASNTVEKPSFISERRTIKQESGRAGVRPSSS
```

```
         .    |    .    |    .    |    .    |    .    |
Q9Y4W9   MPRLRVVHMFLWYLIYGHPASNIVEKPSFISERRTIKQESGRAGVRPSSS
Q63505   MPRLRVMHLFLWYLVYGHPASHTGEQPTFHSERKTGKQEPSRPGVQPSS-
Q12838   --------------------------------------------------
B56011   --------------------------------------------------

860       870       880       890       900
         ....|....|....|....|....|....|....|....|....|....|
NOV21    GSAWEACSEAPSKGSQDGVTWEAEVELATETVYVDDASWMRYIPPIPVHR
Q12789   GSAWEACSEAPSKGSQDGVTWEAEVELATETVYVDDASWMRYIPPIPVHR
Q9Y4W9   GSAWEACSEAPSKGSQDGVTWEAEVELATETVYVDDASWMRYIPPIPVHR
Q63505   GDDWDS-SEA--KNSTESSSWEAEMELSTERVYVDEISWMRYVPPIPIHR
Q12838   --------------------------------------------------
B56011   --------------------------------------------------

910       920       930       940       950
         ....|....|....|....|....|....|....|....|....|....|
NOV21    DFGFGWALVSDILLCLPLSIFIQIVQVSYKVDNLEEFLNDPLKKHTLIRF
Q12789   DFGFGWALVSDILLCLPLSIFIQIVQVSYKVDNLEEFLNDPLKKHTLIRF
Q9Y4W9   DFGFGWALVSDILLCLPLSIFIQIVQVSYKVDNLEEFLNDPLKKHTLIRF
Q63505   DFGFGWALVSDILLCLPLSIFVQVVQVSYKVDNLEDFLNDPLKKHTLIRF
Q12838   --------------------------------------------------
B56011   --------------------------------------------------

960       970       980       990      1000
         ....|....|....|....|....|....|....|....|....|....|
NOV21    LPRPIRQQLLYKRRYIFSVVENLQRLCYMGVLQFGPTEKFQDKDQVFIFL
Q12789   LPRPIRQQLLYKRRYIFSVVENLQRLCYMGVLQFGPTEKFQDKDQVFIFL
Q9Y4W9   LPRPIRQQLLYKRRYIFSVVENLQRLCYMGLLQFGPTEKFQDKDQVFIFL
Q63505   LPRHIRQQLLYKRRYIFSVVENLQRLCYMGLLQFGPTEKFQDKDQVFVFL
Q12838   --------------------------------------------------
B56011   --------------------------------------------------

1010      1020      1030      1040      1050
         ....|....|....|....|....|....|....|....|....|....|
NOV21    KKNAVIVDTTICDPHYNLGRRRRPFERRLYVLNSMQDVENYWFDLQCVCL
Q12789   KKNAVIVDTTICDPHYNLGRRRRPFERRLYVLNSMQDVENYWFDLQCVCL
Q9Y4W9   KKNAVIVDTTICDPHYNLARSSRPFERRLYVLNSMQDVENYWFDLQCVCL
Q63505   KKNAVIVDTTICDPHYNLAHSSRPFERRLYVLDSMQDVESYWFDLQCICL
Q12838   --------------------------------------------------
B56011   --------------------------------------------------

1060      1070      1080      1090      1100
         ....|....|....|....|....|....|....|....|....|....|
NOV21    NTPLGVVRCPRVRKNSSTDQGSDEEGSLQKEQESAMDKHNLERKCAMLEY
Q12789   NTPLGVVRCPRVRKNSSTDQGSDEEGSLQKEQESAMDKHNLERKCAMLEY
Q9Y4W9   NTPLGVVRCPRVRKNSSTDQGSDEEGSLQKEQESAMDKHNLERKCAMLEY
Q63505   NTPLGVVRCPCAQK-ICPDPGSDPEGSLRKEQESAMDKHNLERKCAMLEY
Q12838   --------------------------------------------------
B56011   --------------------------------------------------

1110      1120      1130      1140      1150
         ....|....|....|....|....|....|....|....|....|....|
NOV21    TTGSREVVDEGLIPGDGLGAAGLDSSFYGHLKRNWIWTSYIINQAKKENT
Q12789   TTGSREVVDEGLIPGDGLGAAGLDSSFYGHLKRNWIWTSYIINQAKKENT
Q9Y4W9   TTGSREVVDEGLIPGDGLGAAGLDSSFYGHLKRNWIWTSYIINQAKKENT
Q63505   TTGSREVVDEGLVPGDGLGAAGLDSSFYAHLKRNWVWTSYIINKARKNNT
Q12838   --------------------------------------------------
B56011   --------------------------------------------------

1160      1170      1180      1190      1200
         ....|....|....|....|....|....|....|....|....|....|
NOV21    AAENGLTVRLQTFLSKRPMPLSARGNSRLNIWGEARVGSELCAGWEEQFE
Q12789   AAENGLTVRLQTFLSKRPMPLSARGNSRLNIWGEARVGSELCAGWEEQFE
```

```
Q9Y4W9   AAENGLTVRLQTFLSKRPMPLSARGNSRLNIWGEARVGSELCAGWEEQFE
Q63505   -SENGLTGRLQTFLSKRPMPLGSGGSGRLPLWSEGKADAELCADKEEHFE
Q12838   --------------------------------------------------
B56011   --------------------------------------------------

1210      1220      1230      1240      1250
         ....|....|....|....|....|....|....|....|....|....|
NOV21    VDREPSLDRNRRVRGGKSQKRKRLKKDPGKKIKRKKKGEFDGEKSKRLRY
Q12789   VDREPSLDRNRRVRGGKSQKRKRLKKDPGKKIKRKKKGEFDGEKSKRLRY
Q9Y4W9   VDREPSLDRNRRVRGGKSQKRKRLKKDPGKKIKRKKKGEFDGEKSKRLRY
Q63505   LDREPTPGRNRKVRGGKSQKRKRLKKEPIRKTKRRRGEHPEAKSKKLRY
Q12838   --------------------------------------------------
B56011   --------------------------------------------------

1260      1270      1280      1290      1300
         ....|....|....|....|....|....|....|....|....|....|
NOV21    HDEADQSALHRMTRLRVTWSMQEDGLIVLCRIASNVLNTKVKGPFVTWQV
Q12789   HDEADQSALHRMTRLRVTWSMQEDGLIVLCRIASNVLNTKVKGPFVTWQV
Q9Y4W9   HDEADQSALQRMTRLRVTWSMQEDGLIVLCRIASNVLNTKVKGPFVTWQV
Q63505   QDEADQNALRMMTRLRVSWSMQEDGLIMLCRIASNVLNTKVKGPFVTWQV
Q12838   --------------------------------------------------
B56011   --------------------------------------------------

1310      1320      1330      1340      1350
         ....|....|....|....|....|....|....|....|....|....|
NOV21    VRDILHATFEESLDKTSHSLGRRARYIVKNPQAYLNYKVCLAEVYQDKAL
Q12789   VRDILHATFEESLDKTSHSLGRRARYIVKNPQAYLNYKVCLAEVYQDKAL
Q9Y4W9   VRDILHATFEESLDKTSHSVGRRARYIVKNPQAYLNYKVCLAEVYQDKAL
Q63505   VRDILHATFEESLDKTSHSVGRRARYIVKNPQAFMNYKVCLAEVYQDKAL
Q12838   --------------------------------------------------
B56011   --------------------------------------------------

1360      1370      1380      1390      1400
         ....|....|....|....|....|....|....|....|....|....|
NOV21    VGDFMNRRGDYDDPKVCANEFKEFVEKLKEKFSSALRNSNLEIPDTLQEL
Q12789   VGDFMNRRGDYDDPKVCANEFKEFVEKLKEKFSSALRNSNLEIPDTLQEL
Q9Y4W9   VGDFMNRRGDYDDPKVCANEFKEFVEKLKEKFSSALRNSNLEIPDTLQEL
Q63505   VGDFMSRKDNYEDPKVCAKEFKEFVEKLKEKFSSGLRNPNLEIPDTLQEL
Q12838   --------------------------------------------------
B56011   --------------------------------------------------

1410      1420      1430      1440      1450
         ....|....|....|....|....|....|....|....|....|....|
NOV21    FARYRVLAIGDEKDQTRKEDELNSVDDIHFLVLQNLIQSTLALSDSQMKS
Q12789   FARYRVLAIGDEKDQTRKEDELNSVDDIHFLVLQNLIQSTLALSDSQMKS
Q9Y4W9   FARYRVLAIGDEKDQTRKEDELNSVDDIHFLVLQNLIQSTLALSDSQMKS
Q63505   FAKYRVLAIGDEKDRVRKEDELNSVEDIHFLVLQNLIQSTLSLSNSQSNS
Q12838   --------------------------------------------------
B56011   --------------------------------------------------

1460      1470      1480      1490      1500
         ....|....|....|....|....|....|....|....|....|....|
NOV21    YQSFQTFRLYREYKDHVLVKAFMECQKRSLVNRRRVNHTLGPKKNRALPF
Q12789   YQSFQTFRLYREYKDHVLVKAFMECQKRSLVNRRRVNHTLGPKKNRALPF
Q9Y4W9   YQSFQTFRLYREYKDHVLVKAFMECQKRSLVNRRRVNHTLGPKKNRALPF
Q63505   CQSFQIFRLYREFREPVLVRAFMECQKRSLVNRRRVVHSQGPKKNRAVPF
Q12838   --------------------------------------------------
B56011   --------------------------------------------------

1510      1520      1530      1540      1550
         ....|....|....|....|....|....|....|....|....|....|
NOV21    VPMSYQLSQTYYRIFTWRFPSTICTESFQFLDRMRAAGKLDQPDRFSFKD
Q12789   VPMSYQLSQTYYRIFTWRFPSTICTESFQFLDRMRAAGKLDQPDRFSFKD
```

```
Q9Y4W9     VPMSYQLSQTYYRIFTWRFPSTICTESFQFLDRMRAACKLDQPDRFSFKD
Q63505     VPMSYQLSQSYYKLFTWRFPTTVCTESFQFYDRLRANCILDQPDHFSFKD
Q12838     --------------------------------------------------
B56011     --------------------------------------------------

1560      1570      1580      1590      1600
              ....|....|....|....|....|....|....|....|....|....|
NOV21      QDNNEPTNDMVAFSLDGPGGNCVAVLTLFSLGLISVDVRIPEQIIVVDSS
Q12789     QDNNEPTNDMVAFSLDGPGGNCVAVLTLFSLGLISVDVRIPEQIIVVDSS
Q9Y4W9     QDNNEPTNDMVAFSLDGPGGNCVAVLTLFSLGLISVDVRIPEQIIVVDSS
Q63505     MDSNDPSSDLVAFSLDSPGGHCVTALALFSLGLISVDVRIPEQIVVVDSS
Q12838     --------------------------------------------------
B56011     --------------------------------------------------

1610      1620      1630      1640      1650
              ....|....|....|....|....|....|....|....|....|....|
NOV21      MVENEVIKSLGKDGSLEDDEDEEDDLDEGVGGKRRSMEVKPAQASHTNYL
Q12789     MVENEVIKSLGKDGSLEDDEDEEDDLDEGVGGKRRSMEVKPAQASHTNYL
Q9Y4W9     MVENEVIKSLGKDGSLEDDEDEEDDLDEGVGGKRRSMEVKPAQASHTNYL
Q63505     MVESEVMKSLGKDGGL-DDDEEEDLDEGSGTKRQSVEVKAHQASHTKYL
Q12838     --------------------------------------------------
B56011     --------------------------------------------------

1660      1670      1680      1690      1700
              ....|....|....|....|....|....|....|....|....|....|
NOV21      LMRGYYS-PGIVSTRNLNPNDSIVVNSCQMKFQLRCTPVPARLR---PAA
Q12789     LMRGYYS-PGIVSTRNLNPNDSIVVNSCQMKFQLRCTPVPARLR---PAA
Q9Y4W9     LMRGYYS-PGIVSTRNLNPNDSIVVNSCQMKFQLRCTMVPARLR---PAA
Q63505     LMRGYYTVPCMVSTRNLNPNDSIVVNSCQVKFRLRNTPAPTHLGPTGPTA
Q12838     --------------------------------------------------
B56011     --------------------------------------------------

1710      1720      1730      1740      1750
              ....|....|....|....|....|....|....|....|....|....|
NOV21      APLEELTMGTSCLPDTFTKLINPQENTCSLEEFVLQLELSGYSPEDLTAA
Q12789     APLEELTMGTSCLPDTFTKLINPQENTCSLEEFVLQLELSGYSPEDLTAA
Q9Y4W9     APLEELTMGTSCLPDTFTKLINPQENTCSLEEFVLQLELSGYSPEDLTAA
Q63505     TPLEELQAGPSCLPASETSLVDPQLHTRCPEEFAHQMAQSGYSPEDVAAS
Q12838     --------------------------------------------------
B56011     --------------------------------------------------

1760      1770      1780      1790      1800
              ....|....|....|....|....|....|....|....|....|....|
NOV21      LEILEAIIATGCFGIDKEELRRRFSALEKAGGGRTRTFADCIQALLEQHQ
Q12789     LEILEAIIATGCFGIDKEELRRRFSALEKAGGGRTRTFADCIQALLEQHQ
Q9Y4W9     LEILEAIIATGCFGIDKEELRRRFSALEKAGGGRTRTFADCIQALLEQHQ
Q63505     LEILQAVAAADCFGVDREKLSRQFSALEKIADKRTRTFLDYIQDLLEQQQ
Q12838     --------------------------------------------------
B56011     --------------------------------------------------

1810      1820      1830      1840      1850
              ....|....|....|....|....|....|....|....|....|....|
NOV21      VLEVGGNTARLVAMGSAWPWLLHSVRLKDRE-DADIQREDPQARPLEGSS
Q12789     VLEVGGNTARLVAMGSAWPWLLHSVRLKDRE-DADIQREDPQARPLEGSS
Q9Y4W9     VLEVGGNTARLVAMGSAWPWLLHSVRLKDRE-DADIQREDPQARPLEGSS
Q63505     VMEVGGNTVRLVAMASAQPWLLPSVRLKDVEIDTKASGDDSQSRLPAGSS
Q12838     --------------------------------------------------
B56011     --------------------------------------------------

1860      1870      1880      1890      1900
              ....|....|....|....|....|....|....|....|....|....|
NOV21      SEDSPPEGQAPPSHSPRGTKRRASWASENGETDAEGTQMTPAKRPALQDS
Q12789     SEDSPPEGQAPPSHSPRGTKRRASWASENGETDAEGTQMTPAKRPALQDS
```

```
         1910      1920      1930      1940      1950
         ....|....|....|....|....|....|....|....|....|....|
Q9Y4W9   SEDSPPEGQAPPSHSPRGTKRRASWASENGETDAEGTQMTPAKRPALQDS
Q63505   IEDHTSEGAPIPPVSSNGTKKRPYCSIQSPETDAEEATRLPAKKPTLQDV
Q12838   --------------------------------------------------
B56011   --------------------------------------------------

1910      1920      1930      1940      1950
         ....|....|....|....|....|....|....|....|....|
NOV21    NLAPSLGPGAEDGAEAQAPSPPPALEDTAAAGAAQEDQEGV---------
Q12789   NLAPSLGPGAEDGAEAQAPSPPPALEDTAAAGAAQEDQEGVGEFSSPGQE
Q9Y4W9   NLAPSLGPGAEDGAEAQAPSPPPALEDTAAAGAAQEDQEGVGEFSSPGQE
Q63505   CVAASPRPGTEEQTEAQAQFAAP--EDAGAEGPRQESQESVG-VS--GLE
Q12838   --------------------------------------------------
B56011   --------------------------------------------------

1960      1970      1980      1990      2000
         ....|....|....|....|....|....|....|....|....|
NOV21    ----------------GFTESFGAANISQAARERDCESVCFIGRPWRVVD
Q12789   QLSGQAQPPEGSEDPRGFTESFGAANISQAARERDCESVCFIGRPWRVVD
Q9Y4W9   QLSGQAQPPEGSEDPRGFTESFGAANISQAARERDCESVCFIGRPWRVVD
Q63505   QLGCEFQLPENSEDPRGLTES----NMAQVAWESGCERVCFVGRPWRGVD
Q12838   --------------------------------------------------
B56011   --------------------------------------------------

2010      2020      2030      2040      2050
         ....|....|....|....|....|....|....|....|....|
NOV21    GHLNLPVCKGMMEAMLYHIMTRPGIPESSLLRHYQGVLQPVAVLELLQGL
Q12789   GHLNLPVCKGMMEAMLYHIMTRPGIPESSLLRHYQGVLQPVAVLELLQGL
Q9Y4W9   GHLNLPVCKGMMEAMLYHIMTRPGIPESSLLRHYQGVLQPVAVLELLQGL
Q63505   GRLNMPVCKGMMEAVLYHIMSRPGVPESCLLQYYQGVLQPVAVLELLRGL
Q12838   --------------------------------------------------
B56011   --------------------------------------------------

2060      2070      2080      2090      2100
         ....|....|....|....|....|....|....|....|....|
NOV21    ESLGCIRKRWLRKPRPVSLFSTPVVEEVEVPSSLDE-----SPMAFYEPT
Q12789   ESLGCIRKRWLRKPRPVSLFSTPVVEEVEVPSSLDE-----SPMAFYEPT
Q9Y4W9   ESLGCIRKRWLRKPRPVSLFSTPVVEEVEVPSSLDE-----SPMAFYEPT
Q63505   ESLGCIQKRMLKKPASVSLFSRPVVEGLGQASEAEALSCQGSTVTFYEPT
Q12838   --------------------------------------------------
B56011   --------------------------------------------------

2110      2120      2130      2140      2150
         ....|....|....|....|....|....|....|....|....|
NOV21    LDCTLRLGRVFPHEVNWKWIHL----------------------------
Q12789   LDCTLRLGRVFPHEVNWKWIHL----------------------------
Q9Y4W9   LDCTLRLGRVFPHEVNWKWIHL----------------------------
Q63505   LDCTIRLGRVFPHDINWKQSGSIYRCVPGQQRSLCPCLIVPPGLSQEPRP
Q12838   --------------------------------------------------
B56011   --------------------------------------------------

2160
         ....|....|....|....
NOV21    -------------------
Q12789   -------------------
Q9Y4W9   -------------------
Q63505   SHSCYQSSAQPSTGVATSR
Q12838   -------------------
B56011   -------------------
```

Consistent with other known members of the TFIIIC box B-binding subunit family of proteins, NOV21 has, for example, homology to other members of the TFIIIC box B-binding subunit family and nuclear localization.

NOV21 nucleic acids, and the encoded polypeptides, according to the invention are useful in a variety of applications and contexts. For example, NOV21 nucleic acids and polypeptides can be used to identify proteins that are members of the TFIIIC box B-binding subunit family of proteins. The NOV21 nucleic acids and polypeptides can also be used to screen for molecules, which inhibit or enhance NOV21 activity or function. Specifically, the nucleic acids and polypeptides according to the invention may be used as targets for the identification of small molecules that modulate or inhibit, e.g., gene transcription. These molecules can be used to treat, e.g., cancer and viral disease.

In addition, various NOV21 nucleic acids and polypeptides according to the invention are useful, inter alia, as novel members of the protein families according to the sequence relatedness to previously described proteins. For example, the NOV20 nucleic acids and their encoded polypeptides show homology to proteins belonging to the family of TFIIIC box B-binding subunit proteins such as the α-chain of the Human TFIIIC box B-binding subunit.

Transcription factor IIIC (TFIIIC) is a multisubunit basic TF for RNA polymerase III. It initiates transcription complex assembly on tRNA and related genes by binding to the internal box B promoter element and is also required for transcription of 5S rRNA and other stable nuclear and cytoplasmic RNAs transcribed by polymerase III. In mammalian cells, regulation of TFIIIC activity controls overall polymerase III transcription in response to growth factors and viral infection. A full-length cDNA (and genomic DNA from the transcription initiation region) encoding the box B binding subunit of human TFIIIC, the 243-kDa alpha subunit has been reported and shown to encode a component of TFIIIC. (L'Etoile et al., Proc Natl Acad Sci USA, 91: 1652–6(1994)).

The NOV21 nucleic acids and polypeptides, antibodies and related compounds according to the invention will be useful in therapeutic and diagnostic applications in gene regulation. As such the NOV21 nucleic acids and polypeptides, antibodies and related compounds according to the invention may be used to treat cancer and viral infections, e.g., TFIIIC box B-binding subunit protein is cleaved and inactivated by the poliovirus-encoded 3C protease during poliovirus infection (Shen et al., Mol. Cell. Biol, 16: 4163–71 (1996)).

The NOV21 nucleic acids and polypeptides are useful for detecting specific cell types. For example, expression analysis has demonstrated that a NOV21 nucleic acid is expressed in adrenal gland, bone marrow, brain—amygdala, brain—cerebellum, brain—hippocampus, brain substantia nigra, brain—thalamus, brain—whole, fetal brain, fetal kidney, fetal liver, fetal lung, heart, kidney, lymphoma—Raji, mammary gland, pancreas, pituitary gland, placenta, prostate, salivary gland, skeletal muscle, small intestine, spinal cord, spleen, stomach, testis, thyroid, trachea, uterus, Adipose, Aorta, Bone, Bronchus, Cartilage, Cervix, Chorionic Villus, Colon, Coronary Artery, Dermis, Epidermis, Hypothalamus, Liver, Lung, Lymph node, Lymphoid tissue, Myometrium, Ovary, Peripheral Blood, Respiratory Bronchiole, Retina, Right Cerebellum, synovium/synovial membrane, Temporal Lobe, Thymus, Tonsils, Umbilical Vein, Vein, Vulva, and Whole Organism.

Additional utilities for NOV21 nucleic acids and polypeptides according to the invention are disclosed herein.

NOV22

A NOV22 polypeptide has been identified as a Nucleoside Diphosphate Kinase B-like protein (also referred to as CG56475-01). The disclosed novel NOV22 nucleic acid (SEQ ID NO:74) of 473 nucleotides is shown in Table 22A. The novel NOV22 nucleic acid sequences maps to the chromosome 2.

An ORF begins with an ATG initiation codon at nucleotides 12–14 and ends with a TAA codon at nucleotides 464–466. A putative untranslated region and/or downstream from the termination codon is underlined in Table 22A, and the start and stop codons are in bold letters.

TABLE 22A

NOV22 Nucleotide Sequence (SEQ ID NO:74)

<u>ATCCTCAGGCC</u>ATGGCCAACACTGAGAGCATCATTATCAATCCGAGTGCTGTTCAGCACAGCCTGGT

GGGTGAAATCATCAAATACTCTGAGCAGAAGGGATTCTACCTGGTGACCATGAAGTTCCTTCGGGCC

TCTGAGAAACCCCTGAAGGAGCACTACACTAACCTGAAAGACCACCCATTCTTCCCGGACCTTGTGA

AGTACATGAACTCAGGGCAGGTTGTGGCCATGGTCCTGGAGGGGCTGAATGTGGCAAAGACAGGGCT

AAGGATGCTTGGGGAGACCAATTCATTGGGCTCTATGCTAGAGACTATTATTCGCAGGGACTTCTGC

GCTAAAATAGGCGGGAACGTCATTGGTGGCAGTGATTCATTACAAAGTGCTGGCAAAGAAATGGCTA

AATGGCTTAAAGAAGAAGAACTGGTTGACTACAAATCTCGTGCCTATGACAAGATCTATGATAA<u>AAA</u>

<u>GGAG</u>

The NOV22 protein (SEQ ID NO:75) encoded by SEQ ID NO:74 is 181 amino acid residues in length and is presented using the one-letter amino acid code in Table 22B. Psort analysis predicts the NOV22 protein of the invention to be localized in the cytoplasm with a certainty of 0.6500.

TABLE 22B

Encoded NOV22 protein sequence (SEQ ID NO:75)

MANTESIIINPSAVQHSLVGEIIKYSEQKGFYLVTMKFLRASEKPLKEHYTNLKDHPFFPDLVKYMNSGQVVA

MVLEGLNVAKTGLRMLGETNSLGSMLETIIRRDFCAKIGGNVIGGSDSLQSAGKEMAKWLKEEELVDYKSRAY

DKIYDKKEVKAAVCLDAVPGSLDTALHPIDLEAIG

A search against the Patp database, a proprietary database that contains sequences published in patents and patent publications, yielded several homologous proteins shown in Table

TABLE 22C

Patp results for NOV22

| Sequences producing High-scoring Segment Pairs: | Reading Frame | High Score | Smallest Sum Prob P(N) |
|---|---|---|---|
| >patp: AAY07000 mm23-H2 protein sequence | +1 | 468 | 3.2e−44 |
| >patp: AAB14812 Human nm23 protein nm23-H2S | +1 | 468 | 3.2e−44 |

In a BLAST search of public sequence databases, it was found, for example, that the nucleic acid sequence of this invention has 376 of 475 bases (79%) identical to a gb:GENBANK-ID:HUMPUF|acc:L16785.1 mRNA from *Homo sapiens* (c-myc transcription factor (puf) mRNA, complete cds). The NOV22 polypeptide of the invention was found to have 100 of 152 amino acid residues (65%) identical to, and 113 of 152 amino acid residues (74%) similar to, the 152 amino acid residue ptnr:SWISSPROT-ACC:P22392 protein from *Homo sapiens* (NUCLEOSIDE DIPHOSPHATE KINASE B (EC 2.7.4.6) (NDK B) (NDP KINASE B) (NM23-H2) (C-MYC PURINE-BINDING TRANSCRIPTION FACTOR PUF)).

NOV22 also has homology to the proteins shown in the BLASTP data in Table 22D.

TABLE 22D

BLAST results for NOV22

| Gene Index/ Identifier | Protein/ Organism | Length (aa) | Identity (%) | Positives (%) | Expect |
|---|---|---|---|---|---|
| ptnr: SWISS-PROT-ACC:P22392 | Nucleoside diphosphate kinase B (EC 2.7.4.6) - *Homo sapiens* | 152 | 100/152 (65%) | 113/152 (74%) | 4.0e−44 |
| ptnr: SWISS-PROT-ACC:P19804 | Nucleoside diphosphate kinase B (EC 2.7.4.6) - *Rattus norvegicus* | 152 | 99/152 (65%) | 112/152 (73%) | 5.1e−44 |
| ptnr: SWISS-PROT-ACC: Q01768 | Nucleoside diphosphate kinase B (EC 2.7.4.6) - *Mus musculus* | 152 | 99/152 (65%) | 112/152 (73%) | 8.4e−44 |
| ptnr: SPTR-EMBL-ACC:O57535 | NUCLEOSIDE DIPHOSPHATE KINASE - *Gallus gallus* | 153 | 93/151 (61%) | 109/151 (72%) | 3.7e−41 |
| ptnr: SWISS-PROT-ACC:P15532 | Nucleoside diphosphate kinase A (EC 2.7.4.6) - *Mus musculus* | 152 | 96/152 (63%) | 112/152 (73%) | 4.8e−41 |

A multiple sequence alignment is given in Table 22E, with the NOV22 protein being shown on line 1 in Table 22E in a ClustalW analysis, and comparing the NOV22 protein with the related protein sequences shown in Table 22D. This BLASTP data is displayed graphically in the ClustalW in Table 22E.

Table 22E. ClustalW Analysis of NOV22

1) > NOV22; SEQ ID NO:75
2) > P22392/ Nucleoside diphosphate kinase B (EC 2.7.4.6) [*Homo sapiens*]; SEQ ID NO:256
3) > P19804/ Nucleoside diphosphate kinase B (EC 2.7.4.6) [*Rattus norvegicus*]; SEQ ID NO:257
4) > Q01768/ Nucleoside diphosphate kinase B (EC 2.7.4.6) [*Mus musculus*]; SEQ ID NO:258
5) > O57535/ Nucleoside diphosphate kinase [*Gallus gallus*]; SEQ ID NO:259
6) > P15532/ Nucleoside diphosphate kinase A (EC 2.7.4.6) [*Mus musculus*]; SEQ ID NO:260

```
                   10        20        30        40        50
              ....|....|....|....|....|....|....|....|....|....|
NOV22         -MANTES--IIINPSAVQHSLVGEIIKYSEQKGFYLVTMKFLRASEKPLK
P22392        -MANLERTFIAIKPDGVQRGLVGEIIKRFEQKGFRLVAMKFLRASEEHLK
P19804        -MANLERTFIAIKPDGVQRGLVGEIIKRFEQKGFRLVAMKFLRASEEHLK
Q01768        -MANLERTFIAIKPDGVQRGLVGEIIKRFEQKGFRLVAMKFLRASEEHLK
O57535        MAANCERTFIAIKPDGVQRGLVGEIIKRFEQKGFRLVAMKFVHASEDLLK
P15532        -MANSERTFIAIKPDGVQRGLVGEIIKRFEQKGFRLVGLKFLQASEDLLK 60        70        80        90       100
              ....|....|....|....|....|....|....|....|....|....|
NOV22         EHYTNLKDHPFFPDLVKYMNSGQVVAMVLEGLNVAKTGLRMLGETNSLGS
```

```
         339                                     340

QHYIDLKDRPFFPGLVKYMNSGPVVAMV-EGLNVVKTGRVMLGETNPADS
P22392    QHYIDLKDRPFFPGLVKYMNSGPVVAMV-EGLNVVKTGRVMLGETNPADS
P19804    QHYIDLKDRPFFPGLVKYMNSGPVVAMV-EGLNVVKTGRVMLGETNPADS
Q01768    QHYIDLKDRPFFPGLVKYMNSGPVVAMV-EGLNVVKTGRVMLGETNPADS
O57535    QHYIDLKDRPFYPGLVKYMNSGPVVAMW-EGLNVVKTGRVMLGETNPADS
P15532    EHYTDLKDRPFTGLVKYMHSGPVVAMV-EGLNVVKTGRVMLGETNPADS 110       120       130       140       150
          ....|....|....|....|....|....|....|....|....|....|
NOV22     MLETIIRRDFCAKIGGNVIGGSDSLQSAGKEMAKWLKEEELVDYKSRAYD
P22392    KPGT-IRGDFCIQVGRNIIHGSDSVKSAEKEISLWFKPEELVDYKSCAHD
P19804    KPGT-IRGDFCIQVGRNIIHGSDSVESAEKEIGLWFKPEELIDYKSCAHD
Q01768    KPGT-IRGDFCIQVGRNIIHGSDSVESAEKEIHLWFKPEELIDYKSCAHD
O57535    KPGT-IRGDFCIQVGRNIIHGSDSVESAQKEISLWFKPAELIDYRSCAHD
P15532    KPGT-IRGDFCIQVGRNIIHGSDSVKSAEKEISLWFQPEELVEYKSCAQN 160       170       180
          ....|....|....|....|....|....|....
NOV22     KIYDKKEVKAAVCLDAVPGSLDTALHPIDLEAIG
P22392    WVYE------------------------------
P19804    WVYE------------------------------
Q01768    WVYE------------------------------
O57535    WVYE------------------------------
P15532    WIYE------------------------------
```

The presence of identifiable domains in the protein disclosed herein was determined by searches using algorithms such as PROSITE, Blocks, Pfam, ProDomain, Prints and then determining the Interpro number by crossing the domain match (or numbers) using the Interpro website (http:www.ebi.ac.uk/interpro/). Table 22F lists the domain description from DOMAIN analysis results against NOV22.

TABLE 22F

Domain Analysis of NOV22

| Model | Region of Homology | Score (bits) | E value |
|---|---|---|---|
| Nucleoside diphosphate kinase (NDK) | 7–151 | 173.6 | 3.3e–48 |

Consistent with other known members of the subunit family of proteins, NOV22 has, for example, an Nucleoside Diphosphate Kinase (NDK) signature sequence and homology to other members of the Nucleoside Diphosphate Kinase B family.

NOV22 nucleic acids, and the encoded polypeptides, according to the invention are useful in a variety of applications and contexts. For example, NOV22 nucleic acids and polypeptides can be used to identify proteins that are members of the Nucleo side Diphosphate Kinase B family of proteins. The NOV22 nucleic acids and polypeptides can also be used to screen for molecules, which inhibit or enhance NOV22 activity or function. Specifically, the nucleic acids and polypeptides according to the invention may be used as targets for the identification of small molecules that modulate or inhibit, e.g., nucleic acid synthesis, CTP for lipid synthesis, UTP for polysaccharide synthesis and GTP for protein elongation, signal transduction and microtubule polymerization. These molecules can be used to treat disorders of metabolism, cellular growth and differentiation, e.g., cancer.

In addition, various NOV22 nucleic acids and polypeptides according to the invention are useful, inter alia, as novel members of the protein families according to the presence of domains and sequence relatedness to previously described proteins. For example, the NOV20 nucleic acids and their encoded polypeptides show homology to proteins belonging to the family of Nucleoside Diphosphate Kinase B such as human nicleoside diphosphate kinase B (EC 2.7.4.6).

Nucleoside diphosphate kinases (EC 2.7.4.6) (NDK) are enzymes required for the synthesis of nucleoside triphosphates (NTP) other than ATP. They provide NTPs for nucleic acid synthesis, CTP for lipid synthesis, UTP for polysaccharide synthesis and GTP for protein elongation, signal transduction and microtubule polymerization (Parks, R. and Agarwal R., In: The enzymes—Group transfer. Boyer P. D. (Ed.) Academic Press, New York, 1973, pp. 307–334).

In eukaryotes, there is a small family of NDK isozymes each of which acts in a different subcellular compartment and/or has a distinct biological function. Eukaryotic NDK isozymes are hexamers of two highly related chains (A and B) (Gilles, et al., J. Biol. Chem. 266: 8784–8789(1991)). By random association (A6, A5B . . . AB5, B6), these two kinds of chain form isoenzymes differing in their isoelectric point.

NDK are proteins of 17 Kd that act via a ping-pong mechanism in which a histidine residue is phosphorylated, by transfer of the terminal phosphate group from ATP. In the presence of magnesium, the phosphoenzyme can transfer its phosphate group to any NDP, to produce an NTP.

NDK isozymes have been sequenced from prokaryotic and eukaryotic sources. It has also been shown that the *Drosophila* awd (abnormal wing discs) protein, is a microtubule-associated NDK (Biggs et al., Cell 63: 933–940 (1990)). Mammalian NDK is also known as metastasis inhibition factor nm23. The sequence of NDK has been highly conserved through evolution. There is a single histidine residue conserved in all known NDK isozymes within the NDK signature, which is involved in the catalytic mechanism (Gilles, et al., J. Biol. Chem. 266: 8784–8789 (1991)).

The NOV22 nucleic acids and polypeptides, antibodies and related compounds according to the invention will be useful in therapeutic and diagnostic applications in cellular growth and metabolism. As such the NOV22 nucleic acids and polypeptides, antibodies and related compounds according to the invention may be used to treat cancer, e.g., atherosclerosis, aneurysm, hypertension, fibromuscular dysplasia, stroke, scleroderma, obesity, transplantation, myocardial infarction, embolism, cardiovascular disorders, bypass surgery, fertility disorders, myasthenia gravis, leukodystrophies, pain, neuroprotection, systemic lupus erythematosus, autoimmune disease, asthma, emphysema, scleroderma, allergy, ARDS and other diseases, disorders and conditions of the like.

The NOV22 nucleic acids and polypeptides are useful for detecting specific cell types. For example, expression analysis has demonstrated that a NOV22 nucleic acid is expressed in lymphocyte, placental, liver, cardiovascular, nervous, respiratory, and immune systems, and this protein is found in reduced amount in tumor cells of high metastasic potential. Accordingly, the NOV22 nucleic acids, polypeptides, antibodies and related compounds according to the invention will have diagnostic and therapeutic applications in the detection of cancer.

Additional utilities for NOV22 nucleic acids and polypeptides according to the invention are disclosed herein.

NOV23

A NOV23 polypeptide has been identified as a T-cell-like protein (also referred to as CG56352-02). The disclosed novel NOV23 nucleic acid (SEQ ID NO:76) of 1326 nucleotides is shown in Table 23A. An ORF begins with an ATG initiation codon at nucleotides 19–21 and ends with a TAG codon at nucleotides 1324–1326. A putative untranslated region and/or downstream from the termination codon is underlined in Table 23A, and the start and stop codons are in bold letters. The NOV23 nucleotide sequence maps to chromosome 5.

TABLE 23A

NOV23 Nucleotide Sequence (SEQ ID NO:76)

<u>TGGGGGCGGCTACTGCTC</u>ATGTGATTGTGGAGTAGACAGTTGGAAGAAGTACCCAGTCCATTTGGAG
AGTTAAAACTGTGCCTAACAGAGGTGTCCTCTGACTTTTCTTCTGCAAGCTCCATGTTTTCACATCT
TCCCTTTGACTGTGTCCTGCTGCTGCTGCTACTACTTACAACCCTGTTCTCCCGTGTTCACAGAATT
GGGCCACAATTCTCTCCTAGGGCAGTGTTTCTGAAAGTGAGCAGACAAAATGGGGTAGGGAAACAAT
CAGATAACGCATTTGTGTCTGGCCAGGGTGACCGCACCGGTAAAGATGAGCTATCAATCTGCATTGC
ACAGCTGACCAGGAATTTCCTTGTGGGCAAAATATGGGGGAGTAGCTTCCTCTTTATTCTGTTAGAC
ATGGCTTGCAGTTTTCCTGAAATGGAGTTACCTCACTCACCGCTTGAGTCTTGGCTCTCCTTCTCTC
TCTATGCAGGGTCCTCAGAAGTGGAATACAGAGCGGAGGTCGGTCAGAATGCCTATCTGCCCTGCTT
CTACACCCCAGCCGCCCCAGGGAACCTCGTGCCCGTCTGCTGGGGCAAAGGAGCCTGTCCTGTGTTT
GAATGTGGCAACGTGGTGCTCAGGACTGATGAAAGGGATGTGAATTATTGGACATCCAGATACTGGC
TAAATGGGGATTTCCGCAAAGGAGATGTGTCCCTGACCATAGAGAATGTGACTCTAGCAGACAGTGG
GATCTACTGCTGCCGGATCCAAATCCCAGGCATAATGAATGATGAAAAATTTAACCTGAAGTTGGTC
ATCAAACCAGCCAAGGTCACCCCTGCACCGACTCGGCAGAGAGACTTCACTGCAGCCTTTCCAAGGA
TGCTTACCACCAGGGGACATGGCCCACATGATGGTGGTTCTTGTCTTTCACTTCCAGATGTAAGACT
CACCCAAATATCCACATTGGCCAATGAGTTACGGGACTCTAGATTGGCCAATGACTTACGGGACTCT
GGAGCAACCATCAGAATAGGCATCTACATCGGAGCAGGGATCTGTGCTGGGCTGGCTCTGGCTCTTA
TCTTCGGCGCTTTAATTTTCAAATGTTATTCTCATAGCAAAGAGAAGATACAGAATTTAAGCCTCAT
CTCTTTGGCCAACCTCCCTCCCTCAGGATTGGCAAATGCAGTAGCAGAGGGAATTCGCTCAGAAGAA
AACATCTATACCATTGAAGAGAACGTATATGAAGTGGAGGAGCCCAATGAGTATTATTGCTATGTCA
GCAGCAGGCAGCAACCCTCACAACCTTTGGGTTGTCGCTTTGCAATGCCATAG

The NOV23 protein (SEQ ID NO:77) encoded by SEQ ID NO:76 is 401 amino acid residues in length and is presented using the one-letter amino acid code in Table 23B. NOV23 has one SNP variants, whose variant positions for its nucleotide and amino acid sequences is numbered according to SEQ ID NOS:76 and 77, respectively. A variant sequence can include a single nucleotide polymorphism (SNP). A SNP can, in some instances, be referred to as a "cSNP" to denote that the nucleotide sequence containing the SNP originates as a cDNA. Variant 13376756 is a G to T SNP at 839 bp of the nucleotide sequence that results in an Arg to Leu change at amino acid 240 of protein sequence.

Psort analysis predicts the NOV23 protein of the invention to be localized in the endoplasmic reticulum (membrane) with a certainty of 0.6850. The Signal P predicts a likely cleavage site for a NOV23 peptide is between positions 26 and 27, i.e., at the dash in the sequence VHR-IG.

TABLE 23B

Encoded NOV23 protein sequence (SEQ ID NO:77)

MFSHLPFDCVLLLLLLTTLFSRVHRIGPQFSPRAVFLKVSRQNGVGKQSDNAFVSGQGDRTGKD
ELSICIAQLTRNFLVGKIWGSSFLFILLDMACSFPEMELPHSPLESWLSFSLYAGSSEVEYRAEV
GQNAYLPCFYTPAAPGNLVPVCWGKGACPVFECGNVVLRTDERDVNYWTSRYWLNGDFRKGDVSL
TIENVTLADSGIYCCRIQIPGIMNDEKFNLKLVIKPAKVTPAPTRQRDFTAAFPRMLTTRGHGPH
DGGSCLSLPDVRLTQISTLANELRDSRLANDLRDSGATIRIGIYIGAGICAGLALALIFGALIFK
CYSHSKEKIQNLSLISLANLPPSGLANAVAEGIRSEENIYTIEENVYEVEEPNEYYCYVSSRQQP
SQPLGCRFAMP

A search against the Patp database, a proprietary database that contains sequences published in patents and patent publications, yielded several homologous proteins shown in Table 23C.

TABLE 23C

Patp results for NOV23

| Sequences producing High-scoring Segment Pairs: | Reading Frame | High Score | Smallest Sum Prob P(N) |
|---|---|---|---|
| >patp:AAW01049 Product 200 gene expressed T helper cells | +1 | 1420 | 6.6e−153 |
| >patp:AAY97058 Human T helper cell gene 200 product | +1 | 1420 | 6.6e−153 |
| >patp:AAB51104 Human 200 gene product | +1 | 1420 | 6.6e−153 |
| >patp:AAB59169 Human 200 gene protein | +1 | 1420 | 6.6e−153 |

TABLE 23C-continued

Patp results for NOV23

| Sequences producing High-scoring Segment Pairs: | Reading Frame | High Score | Smallest Sum Prob P(N) |
|---|---|---|---|
| >patp:AAB81518 Human TH1 specific 200 gene product | +1 | 1420 | 6.6e−153 |

In a BLAST search of public sequence databases, it was found, for example, that the NOV23 polypeptide of the invention was found to have 274 of 298 amino acid residues (91%) identical to, and 278 of 298 amino acid residues (93%) similar, to the 301 amino acid residue ptr:SP-TREMBL-ACC:Q96K94 cDNA FLJ14428 FIS, clone HEMBA1006293 (*Homo sapiens*). NOV23 also has homology to the proteins shown in the BLASTP data in Table 23D.

TABLE 23D

BLAST results for NOV23

| Gene Index/ Identifier | Protein/ Organism | Length (aa) | Identity (%) | Positives (%) | Expect |
|---|---|---|---|---|---|
| ptnr:SPTREMBL-ACC:Q96K94 | CDNA FLJ14428 FIS, CLONE HEMBA1006293 - *Homo sapiens* | 301 | 274/298 (91%) | 278/298 (93%) | 8.4e−153 |
| ptnr:TREMBLNEW-ACC:AAL35776 | TIM3 - *Mus musculus* | 281 | 168/275 (61%) | 195/275 (70%) | 1.1e−80 |
| ptnr:SPTREMBL-ACC:O54947 | KIDNEY INJURY MOLECULE-1 PRECURSOR (KIM-1) - *Rattus norvegicus* | 307 | 63/156 (40%) | 83/156 (53%) | 8.1e−31 |
| ptnr:TREMBLNEW-ACC:AAL35774 | TIM1 - *Mus musculus* | 305 | 60/141 (42%) | 77/141 (54%) | 2.3e−30 |
| ptnr:SPTREMBL-ACC:O43656 | HEPATITIS A VIRUS CELLULAR RECEPTOR 1 - *Homo sapiens* | 359 | 52/120 (43%) | 71/120 (59%) | 2.1e−27 |

A multiple sequence alignment is given in Table 23E, with the NOV23 protein being shown on line 1 in Table 23E in a ClustalW analysis, and comparing the NOV23 protein with the related protein sequences shown in Table 23D. This BLASTP data is displayed graphically in the ClustalW in Table 23E.

Table 23E. ClustalW Analysis of NOV23

1) > NOV23; SEQ ID NO:77
2) > Q96K94/cDNA FLJ14428 FIS [*Homo sapiens*]; SEQ ID NO:261
3) > AAL35776/ TIM3 [*Mus musculus*]; SEQ ID NO:262
4) > O54947/ Kidney Injury Molecule-1 Precursor [*Rattus norvegicus*]; SEQ ID NO:263
5) > AAL35774/ TIM1 [*Mus musculus*]; SEQ ID NO:264
6) > O43656/ Hepatitis A Virus Cellular Receptor 1; SEQ ID NO:265

```
           10        20        30        40        50
```

```
                 ....|....|....|....|....|....|....|....|....|....|
NOV23      MFSHLPFDCVLLLLLLLTTLFSRVHRIGPQFSPRAVFLKVSRQNGVGKQS
Q96K94     MFSHLPFDCVLLLLLIL---------------------------------
AAL35776   MFSGLTLNCVLLLLQLL---------------------------------
O54947     -MVQIQVFISGLLLLLPG---------------------------------
AAL35774   -MNQIQVFISGLLLLLPG---------------------------------
O43656     --MHPQVVILSLILHLAD---------------------------------

60        70        80        90       100
                 ....|....|....|....|....|....|....|....|....|....|
NOV23      DNAFVSGQGDRTGKDELSICIAQLTRNFLVGKIWGSSFLFILLDMACSFP
Q96K94     ----------------------LTR-------------------------
AAL35776   ----------------------LAR-------------------------
O54947     --------------------------------------------------
AAL35774   --------------------------------------------------
O43656     --------------------------------------------------

110       120       130       140       150
                 ....|....|....|....|....|....|....|....|....|....|
NOV23      EMELPHSPLESWLSFSLYAGSSEVEYRAEVGQNAYLPCFYTPAAPGNLVP
Q96K94     --------------------SSEVEYRAEVGQNAYLPCFYTLSTPGALVP
AAL35776   --------------------SLENAYVFEVGKNAYLPCSYTLSTPGALVP
O54947     --------------------SVDSYEVVKGVVGHPVTIPCTYST--RGITT
AAL35774   --------------------TVDSYVEVKGVVGHPVTLPCTYST--YRGITT
O43656     --------------------SVAGSVKVGGEAGPSVTLPCHYS----GAVTS 160       170       180       190       200
                 ....|....|....|....|....|....|....|....|....|....|
NOV23      VCWGKGACPVFECGNVVLRTDERDVNYWTS-RYWLNGDFRKGDVSLTIEN
Q96K94     VCWGKGACPVFECGNVVLRTDERDVNYWTS-RYWLNGDFRKGDVSLTIEN
AAL35776   MCWKGFCPWSQCTNELLRTDERNVTYQKSSRYQLKGDLNKGDVSLIIKN
O54947     TCWGRGQCPYSSCQNILIWTNGYQVTYRSSGRYNIKGRISEGDVSLTIEN
AAL35774   TCWGRGQCPSSACQNTLIWTNGHRVTYQKSSRYNLKGHISEGDVSLTIEN
O43656     MCWNRGSCSLFTCQNGIVWTNGTHVTYRKDTRYKLLGDLSRRDVSLTIEN 210       220       230       240       250
                 ....|....|....|....|....|....|....|....|....|....|
NOV23      VTLADSGIYCCRIQIPGIMNDEKFNLKLVIKP-----------------
Q96K94     VTLADSGIYCCRIQIPGIMNDEKFNLKLVIKP-----------------
AAL35776   VTLDDHGTYCCRIQFPGLMNDKKLELKLDIKA-----------------
O54947     SVDSDSGLYCCRVEIPGWFNDQKMTFSLEVKP---------EIPTSPPT
AAL35774   SVESDSGLYCCRVEIPGWFNDQKVTFSLQVKP---------EIPTRPPT
O43656     TAVSDSGVYCCRVEHRGWFNDMKITVSLEIVPPKVTTTPIVTTVPTVTTV 260       270       280       290       300
                 ....|....|....|....|....|....|....|....|....|....|
NOV23      ------AKVTPAPTRQR------DFTAAFPRMLTTRGHGP----HDGGSC
Q96K94     ------AKVTPAPTLQR------DFTAAFPRMLTTRGHGP----AETQTL
AAL35776   ------AKVTPAQTAHG------DSTTASPRTLTTERNG-----SETQTL
O54947     RPTTTRPTTT-RPTTIS------TRSTHVPTSTRVSTSTP----TPEQTQ
AAL35774   RPTTTRPTATGRPTTIS------TRSTHVPTSIRVSTSTPP---TSTHTW
O43656     RTSTTVPTTTTVPTTTVPTTMSIPTTTTVPTTMTVSTTTSVPTTTSIPTT 310       320       330       340       350
                 ....|....|....|....|....|....|....|....|....|....|
NOV23      LSLPDVR-------------------------------------------
Q96K94     GSLPDIN-------------------------------------------
AAL35776   VTLHNNN-------------------------------------------
O54947     THKPEIT---TFYA--------HETTAEVTETP-----------------
AAL35774   THKPEPT---TFCP--------HETTAEVTGIP-----------------
O43656     TSVPVTTTVSTFVPPMPLPRQNHEPVATSPSSPQPAETHPTTLQGAIRRE 360       370       380       390       400
```

351 352

```
             ....|....|....|....|....|....|....|....|....|....|
NOV23        --------------LTQISTLANELRDSRLANDLRDS---GATIRIGIYI
Q96K94       --------------LTQISTLANELRDSRLANDLRDS---GATIRIGIYI
AAL35776     --------------GTKISTWADEIKDS------------GETIRTAIHI
O54947       -------SYTPADWNGTVTSSEE-AWNNHTVRIPLRK--PQRNPTKGFYV
AAL35774     -------SHTPTDWNGTVTSSGD-TWSNHTEAIPPGK--PQKNPTKGFYV
O43656       PTSSPLYSYT-TDGNDTVTESSDGLWNNQTQLFLEHSLLTANTTKGIYA 410       420       430       440       450
             ....|....|....|....|....|....|....|....|....|....|
NOV23        GAGICAGIALALIFGALIFKCYSHSKEKIQNLSLISLANLPPSGLANAVA
Q96K94       GAGICAGIALALIFGALIFKWYSHSKEKIQNLSLISLANLPPSGLANAVA
AAL35776     GVGVSAGITLALIIGVLILKWYSCKKKKLSSILSLITLANLPPGGLANAGA
O54947       GMSVAALLLLLLASTVVVTRYIIIRK-KMGSLSFVAFHVSKSRALQNAAI
AAL35774     GICIAALLLLLVSTVAITRYILMKR-KSASLSVVAFRVSKIEALQNAAV
O43656       GVCISVLVLLAILG-VIIAKKYFFKK-EVQQLS-VSFSSIQIKALQNAVE 460       470       480       490
             ....|....|....|....|....|....|....|....|....|.
NOV23        EGIRSEENIYTIEENVYEVEEPNEYYCYVSSRQQPSQPLGCRFAMP
Q96K94       EGIRSEENIYTIEENVYEVEEPNEYYCYVSSRQQPSQPLGCRFAMP
AAL35776     VRIRSEENIYTIEENVYEVENSNEYYCYVNS-QQPS---------
O54947       VHPRAEDNIYIIEDRSRGAE-------------------------
AAL35774     VHSRAEDNIYIVEDRP-----------------------------
O43656       KEVQAEDNIYIENSLYATD--------------------------
```

The presence of identifiable domains in the protein disclosed herein was determined by searches using algorithms such as PROSITE, Blocks, Pfam, ProDomain, Prints and then determining the Interpro number by crossing the domain match (or numbers) using the Interpro website (http:www.ebi.ac.uk/interpro/). Table 23F lists the domain description from DOMAIN analysis results against NOV23.

TABLE 23F

Domain Analysis of NOV23

| Model | Region of Homology | Score (bits) | E value |
|---|---|---|---|
| Immunoglobulin | 131–212 | 9.8 | 0.18 |
| Peptidase_S8 | 42–62 | 3.3 | 6.2 |

Consistent with other known members of the immunoglobulin superfamily class of proteins, e.g., T-cell proteins, NOV23 has, for example, an immunoglobulin signature sequence and homology to the 'human gene 200' protein (WO1049), may represent a previously unknown splice variant. NOV23 nucleic acids, and the encoded polypeptides, according to the invention are useful in a variety of applications and contexts. For example, NOV23 nucleic acids and polypeptides can be used to identify proteins that are members of the T-cell family of proteins. The NOV23 nucleic acids and polypeptides can also be used to screen for molecules, which inhibit or enhance NOV23 activity or function. Specifically, the nucleic acids and polypeptides according to the invention may be used as targets for the identification of small molecules that modulate or inhibit immune function. These molecules can be used to treat inflammation, allergies, and other immune disorders.

In addition, various NOV23 nucleic acids and polypeptides according to the invention are useful, inter alia, as novel members of the protein families according to the presence of domains and sequence relatedness to previously described proteins. For example, the NOV23 nucleic acids and their encoded polypeptides show homology to proteins belonging to the immunoglobulin superfamily such as kidney injury molecule-1 (KIM-1). KIM-1 seems to play a role in cell adhesion.

The basic structure of immunoglobulin (Ig) molecules is a tetramer of two light chains and two heavy chains linked by disulfide bonds (Gough, Trends Biochem. Sci. 6: 203–205(1981)). There are two types of light chains: kappa and lambda, each composed of a constant domain (CL) and a variable domain (VL). There are five types of heavy chains: alpha, delta, epsilon, gamma and mu, all consisting of a variable domain (VH) and three (in alpha, delta and gamma) or four (in epsilon and mu) constant domains (CH1 to CH4). The major histocompatibility complex (MHC) molecules are made of two chains. In class I the alpha chain is composed of three extracellular domains, a transmembrane region and a cytoplasmic tail (Klein and Figueroa, Immunol. Today 7: 41–44(1986)). The beta chain (beta-2-microglobulin) is composed of a single extracellular domain. In class II (Figueroa and Klein, J. Immunol. Today 7: 78–81(1986)), both the alpha and the beta chains are composed of two extracellular domains, a transmembrane region and a cytoplasmic tail. It is known that the Ig constant chain domains and a single extracellular domain in each type of MHC chains are related (Orr et al., Nature 282: 266–270 (1979); Cushley and Owen, Immunol. Today 4: 88–92 (1983)).

These homologous domains are approximately one hundred amino acids long and include a conserved intradomain disulfide bond. Members of the immunoglobulin superfamily are found in hundreds of proteins of different functions. Examples include antibodies, the giant muscle kinase titin and receptor tyrosine kinases. Immunoglobulin-like domains may be involved in protein—protein and protein-ligand interactions.

The NOV23 nucleic acids and polypeptides, antibodies and related compounds according to the invention will be useful in therapeutic and diagnostic applications in cellular growth and metabolism. As such the NOV23 nucleic acids and polypeptides, antibodies and related compounds according to the invention may be used to immune disorders, e.g., inflammation, allergies, autoimmune disease, and asthma.

The NOV23 nucleic acids and polypeptides are useful for detecting specific cell types. For example, expression analysis has demonstrated that a NOV23 nucleic acid is differentially expressed in mononuclear cells, B and CD4+ lymphocytes, as well as secondary Th1, -2, and Tr1 cells. Accordingly, the NOV23 nucleic acids, polypeptides, antibodies and related compounds according to the invention will have diagnostic and therapeutic applications in the detection of immune disorders and inflammation.

Additional utilities for NOV23 nucleic acids and polypeptides according to the invention are disclosed herein.

NOV24

A NOV24 polypeptide has been identified as a Organin Anion Transporter (OAT)-like protein. The novel NOV24 nucleic acid sequences maps to the chromosome 11. Two alternative novel NOV24, NOV24a and NOV24b, nucleic acids and encoded polypeptides are provided.

NOV24a

A NOV24 variant is the novel NOV24a (alternatively referred to herein as CG56062-01), which includes the 1741 nucleotide sequence (SEQ ID NO:78) shown in Table 24A. A NOV24a ORF begins with a Kozak onsensus sequence ATG initiation codon at nucleotides 5–7 and ends with a TAA codon at nucleotides 1724–1726. Putative untranslated regions upstream from the initiation codon and downstream from the termination codon are underlined in Table 24A, and the start and stop codons are in bold letters.

TABLE 24A

NOV24a Nucleotide Sequence (SEQ ID NO:78)

GCCTATGGCCATGGCCTTCACAGACCTGCTGGATGCTCTGGGCAGCATGGGCCGCTTCCAGCTCAAC

CACACAGCCCTGCTGCTGCTGCCCTGCGGCCTGCTGGCCTGCCACAACTTCCTGCAGAACTTCACCG

CCGCTGTCCCCCCCCACCACTGCCGGGGCCCTGCCAACCACACTGAGGCCTCCACCAACGACTCGGG

GGCCTGGCTGAGGGCCACCATACCCCTGGACCAGCTTGGGGCCCCTGAGCCCTGCCGGCGCTTCACC

TABLE 24A-continued

NOV24a Nucleotide Sequence (SEQ ID NO:78)

AAGCCTCAGTGGGCCCTGCTGAGCCCCAACTCCTCCATCCCGGGCGCGGCCACGGAGGGCTGCAAGG

ACGGCTGGGTCTATAACCGCAGTGTTTTCCCGTCCACCATCGTGATGGAGGTCAGAAGGGGCTGGGT

GTGTGGGGGGCTGCTGCCGAGGCCCAGTCTGAAGCGCCCATGTCTTCCCTGCAGTGGGATCTGGTG

TGTGAGGCCCGCACTCTCCGAGACCTGGCGCAGTCCGTCTACATTGCCGGGGTGCTGGTGGGGCTG

CCGTGTTTGGCAGCTTGGCAGACAGGCTGGGCTGCAAGGGCCCCCTGGTCTGGTCCTACCTGCAGCT

GGCAGCTTCGGGGGCCGCCACAGCGTATTTCAGCTCCTTCAGTGCCTATTGCGTCTTCCGGTTCCTG

ATGGGCATGACCTTCTCTGGCATCGTGGAGTGGATGCCCACACGGGGCCGGACTGTGGCGGGTATTT

TGCTGGGGTATTCCTTCACCCTGGGCCAGCTCATCCTGGCTGGGGTAGCCTACCTGATTCGCCCCTG

GCGGTGCCTGCAGTTTGCCATCTCTGCTCCTTTCCTGATCTTTTTCCTCTATTCTTGGTGGCTTCCA

GAGTCATCCCGCTGGCTCCTCCTGCATGGCAAGTCCCAGTTAGCTGTACAGAATCTGCAGAAGGTGG

CTGCAATGAACGGGAGGAAGCAGGAAGGGGAAAGGCTGACCAAGGAGGTGATGAGCTCCTACATCCA

AAGCGAGTTTGCAAGTGTCTGCACCTCCAACTCAATCTTGGACCTCTTCCGAACCCCGGCCATCCGC

AAGGTCACATGCTGTCTCATGGTGATTTGGTTCTCCAACTCTGTGGCTTACTATGGCCTGGCCATGG

ACCTGCAGAAGTTTGGGCTCAGCCTATACCTGGTGCAGGCCCTGTTTGGAATCATCAACATCCCGGC

CATGCTGGTGGCCACCGCCACCATGATTTACGTGGGCCGCCGTGCCACGGTGGCCTCCTTCCTCATC

CTGGCCGGGCTCATGGTGATCGCCAACATGTTTGTGCCAGAAGGTACGCAGATCCTGTGCACAGCCC

AGGCAGCGCTGGGCAAAGGCTGCCTGGCCAGCTCCTTCATCTGTGTGTACCTGTTTACCGGCGAGCT

GTACCCCACGGAGATCAGGCAGATGGGGATGGGCTTTGCCTCTGTCCACGCCCGCCTCGGGGGCCTG

ACGGCGCCCCTGGTTACCACACTTGGGGAATACAGCACCATCCTGCCACCCGTGAGCTTTGGGGCCA

CCGCAATCCTGGCTGGGCTGGCCGTCTGCTTCCTGACTGAGACCCGCAACATGCCCCTGGTGGAGAC

CATCGCAGCCATGGAGAGGAGGGTCAAAGAAGGCTCTTCCAAGAAACATGTAGAAGAGAAGAGTGAA

GAAATTTCTCTTCAGCAGCTGAGAGCATCTCCCCTCAAAGAGACCATCTAAGCTGCCTGGAACCTG

The NOV24a polypeptide (SEQ ID NO:79) encoded by SEQ ID NO:78 is 573 amino acid residues in length is presented using the one-letter amino acid code in Table 24B. NOV24a has one SNP variant, whose variant position for its nucleotide and amino acid sequences is numbered according to SEQ ID NOS:78 and 79, respectively. A variant sequence can include a single nucleotide polymorphism (SNP). A SNP can, in some instances, be referred to as a "cSNP" to denote that the nucleotide sequence containing the SNP originates as a cDNA. NOV24b Variant 13374434 is a C to T SNP at 190 bp of the nucleotide sequence that result does not result in a change in the protein sequence (silent).

The Psort profile for the NOV24a and NOV24b proteins predicts that this peptides are likely to be localized at the plasma membrane with a certainty of 0.6000. The Signal P predicts a likely cleavage site for a NOV24a peptide is between positions 34 and 35, i.e., at the dash in the sequence LLA-CH. A similar cleavage sit is predicted between positions 41 and 42 in NOV24b.

TABLE 24B

NOV24a protein sequence (SEQ ID NO:79)

MAMAFTDLLDALGSMGRFQLNHTALLLLPCGLLACHNFLQNFTAAVPPHHCRGPANHTEAS

TNDSGAWLRATIPLDQLGAPEPCRRFTKPQWALLSPNSSIPGAATEGCKDGWVYNRSVFPS

TIVMEVRRGWVCGGAAAEAQSEAPMSSLQWDLVCEARTLRDLAQSVYIAGVLVGAAVFGSL

ADRLGCKGPLVWSYLQLAASGAATAYFSSFSAYCVFRFLMGMTFSGIVEWMPTRGRTVAGI

LLGYSFTLGQLILAGVAYLIRPWRCLQFAISAPFLIFFLYSWWLPESSRWLLLHGKSQLAV

QNLQKVAAMNGRKQEGERLTKEVMSSYIQSEFASVCTSNSILDLFRTPAIRKVTCCLMVIW

TABLE 24B-continued

NOV24a protein sequence (SEQ ID NO:79)

FSNSVAYYGLAMDLQKFGLSLYLVQALFGIINIPAMLVATATMIYVGRRATVASFLILAGL

MVIANMFVPEGTQILCTAQAALGKGCLASSFICVYLFTGELYPTEIRQMGMGFASVHARLG

GLTAPLVTTLGEYSTILPPVSFGATAILAGLAVCFLTETRNMPLVETIAAMERRVKEGSSK

KHVEEKSEEISLQQLRASPLKETI

NOV24b

Alternatively, a NOV24 variant is the novel NOV24b (alternatively referred to herein as CG56062-02), which includes the 1690 nucleotide sequence (SEQ ID NO:80) shown in Table 24C. NOV24b sequence was cloned by the polymerase chain reaction (PCR) using the primers: 5' CATGGCCTTCACAGACCTGCT 3' (SEQ ID NO:266) and 5' CAGGTTCCAGGCAGCTTAGATG 3'(SEQ ID NO:267). Primers were designed based on in silico predictions of the full length or some portion (one or more exons) of the cDNA/protein sequence of the invention. These primers were used to amplify a cDNA from a pool containing expressed human sequences derived from the following tissues: adrenal gland, bone marrow, brain—amygdala, brain—cerebellum, brain—hippocampus, brain—substantia nigra, brain thalamus, brain—whole, fetal brain, fetal kidney, fetal liver, fetal lung, heart, kidney, lymphoma Raji, mammary gland, pancreas, pituitary gland, placenta, prostate, salivary gland, skeletal muscle, small intestine, spinal cord, spleen, stomach, testis, thyroid, trachea and uterus.

The NOV24b ORF begins with a Kozak consensus ATG initiation codon at nucleotides 5–7 and ends with a TAA codon at nucleotides 1673–1675. Putative untranslated regions upstream from the initiation codon and downstream from the termination codon are underlined in Table 24C, and the start and stop codons are in bold letters.

TABLE 24C

NOV24b Nucleotide Sequence (SEQ ID NO:80)

GCCTATGGCCATGGCCTTCACAGACCTGCTCATGGCCTTCACAGACCTGCTGGATGCTCTGGGCAGC

ATGGGCCGCTTCCAGCTCAACCACACAGCCCTGCTGCTGCTGCCCTGCGGCCTGCTGGCCTGCCACA

ACTTCCTGCAGAACTTCACGGCCGCTGTCCCCCCCCACCACTGCCGGGGCCCTGCCAACCACACTGA

GGACTCCACCAACGACTCGGGGGCCTGGCTGAGGGCCACCATACCCCTGGACCAGCTTGGGGCCCCT

AAGCCCTGCCGGCGCTTCACCAAGCCTCAGTGGGCCCTGCTGAGCCCCAACTCCTCCATCCCGGGCG

CGGCCACGGAGGGCTGCAAGGACGGCTGGGTCTATAACCGCAGTGTTTTCCCGTCCACCATCGTGAT

GGAGTGGGATCTGGTGTGTGAGGCCCGCACTCTCCGAGACCTGGTGCAGTCCGTCTACATGGCCGGG

GTGCTGGTGGGGGCTGCCGTGTTTGGCAGCTTGGCAGACAGGCTGGGCTGCAAGGGCCCCCTGGTCT

GGTCCTACCTGCAGCTGGCAGCTTCGGGGGCCGCCACAGCGTATTTCAGCTCCTTCAGTGCCTATTG

CGTCTTCCGGTTCCTGATGGGCATGACCTTCTCTGGCATCGTGGAGTGGATGCCCACACGGGGCCGG

ACTGTGGCGGGTATTTTGCTGGGGTATTCCTTCACCCTGGGCCAGCTCATCCTGGCTGGGGTAGCCT

ACCTGATTCGCCCCTGGCGGTGCCTGCAGTTTGCCATCTCTGCTCCTTTCCTGATCTTTTTCCTCTA

TTCTTGGTGGCTTCCAGAGTCATCCCGCTGGCTCCTCCTGCATGGCAAGTCCCAGTTAGCTGTACAG

AATCTGCAGAAGGTGGCTGCAATGAACGGGAGGAAGCAGGAAGGGGAAAGGCTGACCAAGGAGGTGA

TGAGCTCCTACATCCAAAGCGAGTTTGCAAGTGTCTGCACCTCCAACTCAATCTTGGACCTCTTCCG

AACCCCGGCCATCCGCAAGGTCACATGCTGTCTCATGGTGATTTGGTTCTCCAACTCTGTGGCTTAC

TATGGCCTGGCCATGGACCTGCAGAAGTTTGGGCTCAGCCTATACCTGGTGCAGGCCCTGTTTGGAA

TCATCAACATCCCGGCCATGCTGGTGGCCACCGCCACCATGATTTACGTGGGCCGCCGTGCCACGGT

TABLE 24C-continued

NOV24b Nucleotide Sequence (SEQ ID NO:80)

GGCCTCCTTCCTCATCCTGGCCGGGCTCATGGTGATCGCCAACATGTTTGTGCCAGAAGGTACGCAG
ATCCTGTGCACAGCCCAGGCAGCGCTGGGCAAAGGCTGCCTGGCCAGCTCCTTCATCTGTGTGTACC
TGTTTACCGGCGAGCTGTACCCCACGGAGATCAGGCAGATGGGGATGGGCTTTGCCTCTGTCCACGC
CCGCCTCGGGGGCCTGACGGCGCCCCTGGTTACCACACTTGGGGAATACAGCACCATCCTGCCACCC
GTGAGCTTTGGGGCCACCGCAATCCTGGCTGGGCTGGCCGTCTGCTTCCTGACTGAGACCCGCAACA
TGCCCCTGGTGGAGACCATCGCAGCCATGGAGAGGAGGGTCAAAGAAGGCTCTTCCAAGAAACATGT
AGAAGAGAAGAGTGAAGAAATTTCTCTTCAGCAGCTGAGAGCATCTCCCCTCAAAGAGACCATCTAA
GCTGCCTGGAACCTG

The NOV24b protein (SEQ ID NO:81) encoded by SEQ ID NO:80 is 556 amino acid residues in length and is presented using the one-letter code in Table 24D.

TABLE 24D

NOV24b protein sequence (SEQ ID NO:81)

MAMAFTDLLMAFTDLLDALGSMGRFQLNHTALLLLPCGLLACHNFLQNFTAAVPPHHCRGPANHTED
STNDSGAWLRATIPLDQLGAPKPCRRFTKPQWALLSPNSSIPGAATEGCKDGWVYNRSVFPSTIVME
WDLVCEARTLRDLVQSVYMAGVLVGAAVFGSLADRLGCKGPLVWSYLQLAASGAATAYFSSFSAYCV
FRFLMGMTFSGIVEWMPTRGRTVAGILLGYSFTLGQLILAGVAYLIRPWRCLQFAISAPFLIFFLYS
WWLPESSRWLLLHGKSQLAVQNLQKVAAMNGRKQEGERLTKEVMSSYIQSEFASVCTSNSILDLFRT
PAIRKVTCCLMVIWFSNSVAYYGLAMDLQKFGLSLYLVQALFGIINIPAMLVATATMIYVGRRATVA
SFLILAGLMVIANMFVPEGTQILCTAQAALGKGCLASSFICVYLFTGELYPTEIRQMGMGFASVHAR
LGGLTAPLVTTLGEYSTILPPVSFGATAILAGLAVCFLTETRNMPLVETIAAMERRVKEGSSKKHVE
EKSEEISLQQLRASPLKETI

NOV24 Clones

Unless specifically addressed as NOV24a or NOV24b, any reference to NOV24 is assumed to encompass all variants. NOV24b polypeptide sequence is 17 amino acids shorter than NOV24a polypeptide and also has 13 different amono acids shown in Table 24E.

Table 24E. Information for the ClustalW proteins:

```
              10         20         30         40         50
         ....|....|....|....|....|....|....|....|....|....|
NOV24a   -------MAMAFTDLLDALGSMGRFQLNHTALLLLPCGLLACHNFLQNFT
NOV24b   MAMAFTDLLMAFTDLLDALGSMGRFQLNHTALLLLPCGLLACHNFLQNFT 60         70         80         90        100
         ....|....|....|....|....|....|....|....|....|....|
NOV24a   AAVPPHHCRGPANHTEASTNDSGAWLRATIPLDQ-GAPEPCRRFTKPQWA
NOV24b   AAVPPHHCRGPANHTEDSTNDSGAWLR-TIPLDQLGAPKPCRRFTKPQWA 110        120        130        140        150
         ....|....|....|....|....|....|....|....|....|....|
NOV24a   LLSPNSSIPGAATEGCKDGWVYNRSVFPSTIVMEVRRGWVCGGAAAEAQS
NOV24b   LLSPNSSIPGAATEGCKDGWVYNRSVFPSTIVMEWD---LVC--------

160        170        180        190        200
         ....|....|....|....|....|....|....|....|....|....|
NOV24a   EAPMSSLQWDLVEARTLRDLAQSVYIAGVLVGAAVFGSLADRLGCKGPLV
NOV24b   ------------EARTLRDLVQSVYMAG-LVGAAVFGSLADRLGCKGPLV 210        220        230        240        250
         ....|....|....|....|....|....|....|....|....|....|
NOV24a   WSYLQLAASGAATAYFSSFSAYCVFRFLMGMTFSGIVEW-PTRGRTVAGI
NOV24b   WSYLQLAASGAATAYFSSFSAYCVFRFLMGMTFSGIVEWMPTRGRTVAGI 260        270        280        290        300
         ....|....|....|....|....|....|....|....|....|....|
NOV24a   LLGYSFTLGQLILAGVAYLIRPWRCLQFAISAPFLIFFLYSWWLPESSRW
NOV24b   LLGYSF-LGQLILAGVAYLIRPWRCLQFAISAPFLIFFLYSWWLPESSRW 310        320        330        340        350
         ....|....|....|....|....|....|....|....|....|....|
NOV24a   LLLHGKSQLAVQNLQKVA-MNGRKQEGERLTKEVMSSYIQSEFASVCTSN
NOV24b   LLLHGKSQLAVQNLQKVAAMNGRKQEGERLTKEVSS-YIQSEFASVCTSN 360        370        380        390        400
         ....|....|....|....|....|....|....|....|....|....|
NOV24a   SILDLFRTPAIRKVTCCLMVIWFSNSVAYYGLAMDLQKFGLSLYL-QALF
NOV24b   SILDLFRTPAIRKVTCCLMVIWFSNSVAYYGLAMDLQKFGLSLYLVQALF 410        420        430        440        450
         ....|....|....|....|....|....|....|....|....|....|
NOV24a   GIINIPAMLVATATMIYVGRRATVASFLILAGLMVIANMFVPEGTQILCT
NOV24b   GIINIPAMLVAT-TMIYVGRRATVASFLILAGLMVIANMFVPEGTQILCT 460        470        480        490        500
         ....|....|....|....|....|....|....|....|....|....|
NOV24a   AQAALGKGCLASSFICVYLFTGE-YPTEIRQMGMGFASVHARLGGLTAPL
NOV24b   AQAALGKGCLASSFICVYLFTGELYPTEIRQMGMGFASVH-RLGGLTAPL 510        520        530        540        550
         ....|....|....|....|....|....|....|....|....|....|
NOV24a   VTTLGEYSTILPPVSFGATAILAGLAVCFLTETRNMPLVETIAAMERRVK
NOV24b   VTTLGEYSTILPPVSFGATAILAGLAVCFLTETRNMPLVETIAAMERRVK 560        570
         ....|....|....|....|....|....
```

```
NOV24a  E-SSKKHVEEKSEEISLQQLRASPLKETI
NOV24b  EGSSKKHVEEKSEEISLQ-LRASPLKETI
```

A search against the Patp database, a proprietary database that contains sequences published in patents and patent publications, yielded several homologous proteins shown in Table 24F and Table 24G.

TABLE 24F

Patp results for NOV24a

| Sequences producing High-scoring Segment Pairs: | Reading Frame | High Score | Smallest Sum Prob P(N) |
|---|---|---|---|
| >patp:AAB36553 Mouse organic anion transporter 5 (OATP5) | +1 | 978 | 1.1e−126 |
| >patp:AAY92903 Rat cerebral OAT3 | +1 | 1009 | 6.6e−125 |
| >patp:AAB47274 hOAT3 | +1 | 992 | 3.2e−123 |
| >patp:AAY92902 Human cerebral OAT3 | +1 | 991 | 4.1e−123 |
| >patp:AAW44195 Mouse osteoclast transporter protein | +1 | 990 | 9.7e−122 |

TABLE 24G

Patp results for NOV24b

| Sequences producing High-scoring Segment Pairs: | Reading Frame | High Score | Smallest Sum Prob P(N) |
|---|---|---|---|
| >patp:AAY44278 Human organic anion transporter | +1 | 1256 | 1.0e−127 |
| >patp:AAB47271 hOAT1 | +1 | 1256 | 1.0e−127 |
| >patp:AAW88488 Rat organic anion transporter OAT-1 | +1 | 1254 | 1.6e−127 |

TABLE 24G-continued

Patp results for NOV24b

| Sequences producing High-scoring Segment Pairs: | Reading Frame | High Score | Smallest Sum Prob P(N) |
|---|---|---|---|
| >patp:AAW88489 Human organic anion transporter OAT-1 | +1 | 1249 | 5.5e−127 |
| >patp:AAY92903 Rat cerebral OAT3 | +1 | 1239 | 6.3e−126 |

In a BLAST search of public sequence databases, it was found, for example, that the NOV24a nucleic acid sequence of this invention has 680 of 1082 bases (62%) identical to a gb:GENBANK-ID:OCU242871 |acc:AJ242871.1 mRNA from *Oryctolagus cuniculus* (*Oryctolagus cuniculus* mRNA for renal organic anion transporter 1 (rbOAT1)) (FIG. 3A). NOV24a polypeptide was found to have 196 of 424 amino acid residues (46%) identical to, and 277 of 424 amino acid residues (65%) similar to, the 536 amino acid residue ptnr:SPTREMBL-ACC:Q9R1U7 protein from *Rattus norvegicus* (ORGANIC ANION TRANSPORTER 3).

Similarly, it was found, for example, that the NOV24b nucleic acid sequence of this invention has 713 of 1132 bases (62%) identical to a gb:GENBANK-ID:AF097491 |acc:AF097491.1 mRNA from *Homo sapiens* (*Homo sapiens* organic anion transporter 3 (OAT3) mRNA, complete cds). NOV24b was found to have 246 of 522 amino acid residues (47%) identical to, and 328 of 522 amino acid residues (62%) similar to, the 563 amino acid residue ptnr:SP-TREMBL-ACC:O95742 protein from *Homo sapiens* (RENAL ORGANIC ANION TRANSPORT PROTEIN 1).

Additional BLAST results are shown in Table 24H and Table I.

TABLE 24H

BLAST results for NOV24a

| Gene Index/ Identifier | Protein/Organism | Length (aa) | Identity (%) | Positives (%) | Expect |
|---|---|---|---|---|---|
| gi|17472512|ref|XP_061724.1|(XM_061724) | similar to putative renal organic anion transporter 1 [*Homo sapiens*] | 705 | 338/400 (84%) | 341/400 (84%) | 0.0 |
| gi|3831566|gb|AAC70004.1|(AF057039) | putative renal organic anion transporter 1 [*Homo sapiens*] | 550 | 236/550 (42%) | 314/550 (56%) | 1e-119 |
| gi|4759042|ref|NP_004781.1|(NM_004790) | solute carrier family 22 (organic anion transporter), member 6; renal organic anion transporter 1 [*Homo sapiens*] | 550 | 236/550 (42%) | 314/550 (56%) | 1e-118 |
| gi|4579723|dbj|BAA75072.1|(AB009697) | hOAT1-1 [*Homo sapiens*] | 563 | 236/550 (42%) | 314/550 (56%) | 1e-118 |
| gi|2687858|emb|CAB09724.1|(Z97028) | renal organic anion transporter [*Pseudopleuronectes americanus*] | 562 | 237/557 (42%) | 323/557 (57%) | 1e-118 |

TABLE 24I

BLAST results for NOV24b

| Gene Index/ Identifier | Protein/Organism | Length (aa) | Identity (%) | Positives (%) | Expect |
|---|---|---|---|---|---|
| gi\|17472512\|ref\|XP_061724.1\|(XM_061724) | similar to putative renal organic anion transporter 1 [Homo sapiens] | 705 | 308/400 (77%) | 314/400 (78%) | 1e-165 |
| gi\|4579723\|dbj\|BAA75072.1\|(AB009697) | hOAT1-1 [Homo sapiens] | 563 | 235/526 (44%) | 312/526 (58%) | 1e-122 |
| gi\|3831566\|gb\|AAC70004.1\|(AF057039) | putative renal organic anion transporter 1 [Homo sapiens] | 550 | 235/526 (44%) | 312/526 (58%) | 1e-122 |
| gi\|4759042\|ref\|NP_004781.1\|(NM_004790) | solute carrier family 22 (organic anion transporter), member 6; renal organic anion transporter 1 [Homo sapiens] | 550 | 235/526 (44%) | 312/526 (58%) | 1e-122 |
| gi\|8393886\|ref\|NP_058920.1\|(NM_017224) | organic cationic transporter-like 1 [Rattus norvegicus] | 551 | 234/526 (44%) | 313/526 (59%) | 1e-121 |

A multiple sequence alignment is given in Table 24J, with the NOV24a protein of the invention being shown on line 1, in a ClustalW analysis comparing NOV24a with related protein sequences disclosed in Table 24H.

Table 24J. Information for the ClustalW proteins (NOV24a):

1. \>NOV24a; SEQ ID NO:79
2. \>gi|17472512|/ similar to putative renal organic anion transporter [*Homo sapiens*]; SEQ ID NO:268
3. \>gi|3831566|/ putative renal organic anion transporter 1 [*Homo sapiens*]; SEQ ID NO:269
4. \>gi|4759042|/ solute carrier family 22 [*Homo sapiens*]; SEQ ID NO:270
5. \>gi|4579723|/ hOAT1-1 [*Homo sapiens*]; SEQ ID NO:271
6. \>gi|2687858|/ renal organic anion transporter [*Pseudopleuronectes americanus*]; SEQ ID NO:272

```
                        10         20         30         40         50
                 ....|....|....|....|....|....|....|....|....|....|
    NOV24a       --------------------------------MAMAFTDLLDALGSMGR
    gi|1747251   MSAVLTPGLFLPLPGPLPASLHKAGGTGPQVRPMAMAFTDLLDALGSMGR
    gi|3831566   --------------------------------MAFNDLLQQVGGVGR
    gi|4759042   --------------------------------MAFNDLLQQVGGVGR
    gi|4579723   --------------------------------MAFNDLLQQVGGVGR
    gi|2687858   --------------------------------MPESELLEQVGSTGR 60         70         80         90        100
                 ....|....|....|....|....|....|....|....|....|....|
    NOV24a       FQLNHTALLLLPCGLLACHNFLQNFTAAVPPHHCRGPAN--HTEASTNDS
    gi|1747251   FQLNHTALLLLPCGLLACHNFLQNFTAAVPPHHCRGPAN--DANLSKNGG
    gi|3831566   FQQIQVTLVVLPLLLMASHNTLQNFTAAIPTHHCRPPA---DANLSKNGG
    gi|4759042   FQQIQVTLVVLPLLLMASHNTLQNFTAAIPTHHCRPPA---DANLSKNGG
    gi|4579723   FQQIQVTLVVLPLLLMASHNTLQNFTAAIPTHHCRPPA---DANLSKNGG
    gi|2687858   FQVLHVTLLCIPVLMMASHNLLQNFVATVPSHYCNAHANLSQARLSLEES 110        120        130        140        150
                 ....|....|....|....|....|....|....|....|....|....|
    NOV24a       GAWLRATIPLDQLGAPEPCRRFTKPQWALLSPN-SSIPG--------A
    gi|1747251   GAWLRATIPLDQLGAPEPCRRFTKPQWALLSPN-SSIPG--------A
    gi|3831566   ---LEVWLERDRQGQPESCLRFTSPQWGLPFLNGTEANG--------TG
```

```
            371                                          372 gi|4759042   ---LEVWLPRDRQGQPESCLRFTSPQWGLPFLNGTEANG---------TG
gi|4579723   ---LEVWLPRDRQGQPESCLRFTSPQWGLPFLNGTEANG---------TG
gi|2687858   ---LLITVPLDGAGKPQRCQRYAAPQWHLLGKNGTSGSGDLADATESMDA 160        170        180        190        200
                  ....|....|....|....|....|....|....|....|....|....|
NOV24a       ATEGCKDGWVYNRSVFPSTIVMEVRRGWVCGGAAAEAQSEAPMSSLQWDL
gi|1747251   ATEGCKDGWVYNRSVFPSTIVMEVRRGWVCGGAAAEAQSEAPMSSLQWDL
gi|3831566   ATEPCTDGWIYDNSTFPSTIVT---------------------EWDL
gi|4759042   ATEPCTDGWIYDNSTFPSTIVT---------------------EWDL
gi|4579723   ATEPCTDGWIYDNSTFPSTIVT---------------------EWDL
gi|2687858   ALQECSDGWSYNSTVRSSTIIS---------------------EWHL 210        220        230        240        250
                  ....|....|....|....|....|....|....|....|....|....|
NOV24a       VCEARTLRDLAQSVYIAGVLVGAAVFGSLADRLGCKGPLVWSYLQLAASG
gi|1747251   VCEARTLRDLAQSVYIAGVLVGAAVFGSLADRLGCKGPLVWSYLQLAASG
gi|3831566   VCSHRALRQLAQSLYMVGVLLGAMVFGYLADRLGRRKVLILNYLQTAVSG
gi|4759042   VCSHRALRQLAQSLYMVGVLLGAMVFGYLADRLGRRKVLILNYLQTAVSG
gi|4579723   VCSHRALRQLAQSLYMVGVLLGAMVFGYLADRLGRRKVLILNYLQTAVSG
gi|2687858   VCDMHSFKQMGQTIYMGGVLVGALLFGGLSDRYGRRILLLISNLLMAVSG 260        270        280        290        300
                  ....|....|....|....|....|....|....|....|....|....|
NOV24a       AATAYFSSFSAYCVFRFLMGMTFSG-------------------------
gi|1747251   AATAYFSSFSAYCVFRFLMGMTFSGIILNSVSLPPARVLDLGDLGSRVVV
gi|3831566   TCAAFAPNFPIYCAFRLLSGMALAGISLN--------------------
gi|4759042   TCAAFAPNFPIYCAFRLLSGMALAGISLN--------------------
gi|4579723   TCAAFAPNFPIYCAFRLLSGMALAGISLN--------------------
gi|2687858   TCAAFSSSFSLFCVFRFGCGLALSGLGLN--------------------

310        320        330        340        350
                  ....|....|....|....|....|....|....|....|....|....|
NOV24a       -----IVEWMPTRGRTVAGILLGYSFTLGQLILAGVAYLIRPWRCLQFAI
gi|1747251   ALLAVVVEWMPTRGRTVAGILLGYSFTLGQLILAGVAYLIRPWRCLQFAI
gi|3831566   -CMTLNVEWMPIHTRACVGTLIGYVYSLGQFLLAGVAYAVPHWRHLQLLV
gi|4759042   -CMTLNVEWMPIHTRACVGTLIGYVYSLGQFLLAGVAYAVPHWRHLQLLV
gi|4579723   -CMTLNVEWMPIHTRACVGTLIGYVYSLGQFLLAGVAYAVPHWRHLQLLV
gi|2687858   -TFSLIVEWIPTRIRTAVGTTTGYCYTLGQLILVLLAYFIRDWRWLTLAV 360        370        380        390        400
                  ....|....|....|....|....|....|....|....|....|....|
NOV24a       SAPFLIFFLYSWWLPESSRWLLLHGKSQLAVQNLQKVAAMNGRKQEGERL
gi|1747251   SAPFLIFFLYSWWLPESSRWLLLHGKSQLAVQNLQKVAAMNGRKQEGERL
gi|3831566   SAPFFAFFIYSWFFIESARWHSSSGRLDLTLRALQRVARINGKREEGAKL
gi|4759042   SAPFFAFFIYSWFFIESARWHSSSGRLDLTLRALQRVARINGKREEGAKL
gi|4579723   SAPFFAFFIYSWFFIESARWHSSSGRLDLTLRALQRVARINGKREEGAKL
gi|2687858   SLPFYVFFLIAWWFHESSRWLALSNRTEHALKNLKSVARFNGRHEEAEKL 410        420        430        440        450
                  ....|....|....|....|....|....|....|....|....|....|
NOV24a       TKEVMSSYIQSEFASVCTSNSILDLFRTPAIRKVTCCLMVIWF-------
gi|1747251   TKEVMSSYIQSEFASVCTSNSILDLFRTPAIRKVTCCLMVIWWGHSPMEP
gi|3831566   SMEVLRASLQKELTMGKGQASAMELLRCPTLRHLFLCLSMLWF-------
gi|4759042   SMEVLRASLQKELTMGKGQASAMELLRCPTLRHLFLCLSMLWF-------
gi|4579723   SMEVLRASLQKELTMGKGQASAMELLRCPTLRHLFLCLSMLWF-------
gi|2687858   DIKMLHESMKKEMSCTQGSYSILDLFNTPAMRKRTLCLSAVWL-------

460        470        480        490        500
                  ....|....|....|....|....|....|....|....|....|....|
NOV24a       --------------------------------------------------
gi|1747251   TRPAQSCPGNRRFGSRTPGLANRTRKIGAMSKCFASLPAGSRAGLAPGIN
gi|3831566   --------------------------------------------------
```

Table 24K. Information for the ClustalW proteins (NOV24b):

1. >NOV24b; SEQ ID NO:81
2. >gi|17472512|/ similar to putative renal organic anion transporter 1 [*Homo sapiens*]; SEQ ID NO:273
3. >gi|4579723|/ hOAT1-1 [*Homo sapiens*]; SEQ ID NO:274
4. >gi|3831566|/ putative renal organic anion transporter 1 [*Homo sapiens*]; SEQ ID NO:275
5. >gi|4759042|/ solute carrier family 22 [*Homo sapiens*]; SEQ ID NO:276
6. >gi|8393886|/ organic cationic transporter-like 1 [*Rattus norvegicus*]; SEQ ID NO:277

```
                        10        20        30        40        50
                 ....|....|....|....|....|....|....|....|....|....|
NOV24b           MAMAFTDLLMAFTDLLDALGSMGRFQLNHTALLLPCGLLACHNPLQNFT
gi|4579723       --------MAFNDLLQQVGGVGRFQQIQVTLVVLPLLLMASHNTLQNFT
gi|3831566       --------MAFNDLLQQVGGVGRFQQIQVTLVVLPLLLMASHNTLQNFT
gi|4759042       --------MAFNDLLQQVGGVGRFQQIQVTLVVLPLLLMASHNTLQNFT
gi|8393886       --------MAFNDLIKQVGGVGRFQLIQVTMVVAPLLLMASHNTLQNFT 60        70        80        90       100
                 ....|....|....|....|....|....|....|....|....|....|
NOV24b           AAVPPHHCRGPANHTEDSTNDSGAWLRATIPLDQLGAPKPCRRFTKPQWA
gi|4579723       AAIPTHHCRPPADANLSKNGGLEVWL----PRDRQGQPESCLRFTSPQWG
gi|3831566       AAIPTHHCRPPADANLSKNGGLEVWL----PRDRQGQPESCLRFTSPQWG
gi|4759042       AAIPTHHCRPPADANLSKNGGLEVWL----PRDRQGQPESCLRFTSPQWG
gi|8393886       AAIPPHHCRPPANANLSKDGGLEAWL----PLDKQGQPESCLRFTSPQWG 110       120       130       140       150
                 ....|....|....|....|....|....|....|....|....|....|
NOV24b           LLSPNSSIPG--AATEGCKDGWVYNRSVFPSTIVMEWDLVCEARTLRDEV
gi|4579723       LPFLNGTEANGTGATEPCTDGWIYDNSTFPSTIVTEWDLVCSHRALRQLA
gi|3831566       LPFLNGTEANGTGATEPCTDGWIYDNSTFPSTIVTEWDLVCSHRALRQLA
gi|4759042       LPFLNGTEANGTGATEPCTDGWIYDNSTFPSTIVTEWDLVCSHRALRQLA
gi|8393886       PPFYNGTEANGTRVTEPCIDGWVYDNSTFPSTIVTEWNLVCSHRAFRQLA 160       170       180       190       200
                 ....|....|....|....|....|....|....|....|....|....|
NOV24b           QSVYMAGVIVGAAVFGSLADRLGCKGPLVWSYLQLAASGAATAYFSSFSA
gi|4579723       QSLYMVGVLLGAMVFGYLADRLGRRKVLILNYLQTAVSGTCAAFAPNFPI
gi|3831566       QSLYMVGVLLGAMVFGYLADRLGRRKVLILNYLQTAVSGTCAAFAPNFPI
gi|4759042       QSLYMVGVLLGAMVFGYLADRLGRRKVLILNYLQTAVSGTCAAFAPNFPI
gi|8393886       QSLYMVGVLLGAMVFGYLADRLGRRKVLILNYLQTAVSGTCAAYAPNYTV 210       220       230       240       250
                 ....|....|....|....|....|....|....|....|....|....|
NOV24b           YCVFRELMGMTFSGI-------VEWMPTRGRTVAGILLGYSFTLGQLIL
gi|4579723       YCAFRLLSGMALAGISLNCMTLNVEWMPIHTRACVGTLIGYVYSLGQFLL
gi|3831566       YCAFRLLSGMALAGISLNCMTLNVEWMPIHTRACVGTLIGYVYSLGQFLL
gi|4759042       YCAFRLLSGMALAGISLNCMTLNVEWMPIHTRACVGTLIGYVYSLGQFLL
gi|8393886       YCVFRLLSGMSLASIAINCMTLNVEWMPIHTRAYVGTLIGYVYSLGQFLL
```

A similar multiple sequence alignment is given in Table 24K, with the NOV24b protein of the invention being shown on line 1, in a ClustalW analysis comparing NOV24b with related protein sequences disclosed in Table 24I.

```
              260        270        280        290        300
          ....|....|....|....|....|....|....|....|....|....|
NOV24b    AGVAYLIRPWRCLQFAISAPFLIFFLYSWWLPESSRWLLLHGKSQLAVQN
gi|4579723 AGVAYAVPHWRHLQLLVSAPFFAFFIYSWFFIESARWHSSSGRLDLTLRA
gi|3831566 AGVAYAVPHWRHLQLLVSAPFFAFFIYSWFFIESARWHSSSGRLDLTLRA
gi|4759042 AGVAYAVPHWRHLQLLVSAPFFAFFIYSWFFIESARWHSSSGRLDLTLRA
gi|8393886 AGIAYAVPHWRHLQLVVSVPFFIAFIYSWFFIESARWYSSSGRLDLTLRA 310        320        330        340        350
          ....|....|....|....|....|....|....|....|....|....|
NOV24b    LQKVAAMNGRKQEGERLTKEVMSSYIQSEFASVCTSNSILDLFRTPAIRK
gi|4579723 LQRVARINGKREEGAKLSMEVLRASLQKELTMGKGQASAMELLRCPTLRH
gi|3831566 LQRVARINGKREEGAKLSMEVLRASLQKELTMGKGQASAMELLRCPTLRH
gi|4759042 LQRVARINGKREEGAKLSMEVLRASLQKELTMGKGQASAMELLRCPTLRH
gi|8393886 LQRVARINGKQEEGAKLSIEVLRTSLQKELTLSKGQASAMELLRCPTLRH 360        370        380        390        400
          ....|....|....|....|....|....|....|....|....|....|
NOV24b    VTCCLMVIWFSNSVAYYGLAMDLQKFGLSLYLVQALFGIINIPAMLVATA
gi|4579723 LFLCLSMLWFATSFAYYGLVMDLQGFGVSIYLIQVIFGAVDLPAKLVGFL
gi|3831566 LFLCLSMLWFATSFAYYGLVMDLQGFGVSIYLIQVIFGAVDLPAKLVGFL
gi|4759042 LFLCLSMLWFATSFAYYGLVMDLQGFGVSIYLIQVIFGAVDLPAKLVGFL
gi|8393886 LFLCLSMLWFATSFAYYGLVMDLQGFGVSMYLIQVIFGAVDLPAKFVCFL 410        420        430        440        450
          ....|....|....|....|....|....|....|....|....|....|
NOV24b    TMIYVGRRATVASFLILAGLMVIANMFVPEGTQILCTAQAALGKGCLASS
gi|4579723 VINSLGRRPAQMAALLLAGICILLNGVIPQDQSIVRTSLAVLGKGCLAAS
gi|3831566 VINSLGRRPAQMAALLLAGICILLNGVIPQDQSIVRTSLAVLGKGCLAAS
gi|4759042 VINSLGRRPAQMAALLLAGICILLNGVIPQDQSIVRTSLAVLGKGCLAAS
gi|8393886 VINSMGRRPAQMASLLLAGICILVNGIIPKSHTIIRTSLAVLGKGCLASS 460        470        480        490        500
          ....|....|....|....|....|....|....|....|....|....|
NOV24b    FICVYLFTGELYPTEIRQMGMGFASVHARLGGLTAPLVTTLGEYSTILPP
gi|4579723 FNCIFLYTGELYPTMIRQTGMGMGSTMARVGSIVSPLVSMTAELYPSMPL
gi|3831566 FNCIFLYTGELYPTMIRQTGMGMGSTMARVGSIVSPLVSMTAELYPSMPL
gi|4759042 FNCIFLYTGELYPTMIRQTGMGMGSTMARVGSIVSPLVSMTAELYPSMPL
gi|8393886 FNCIFLYTGELYPTVIRQTGLGMGSTMARVGSIVSPLVSMTAEFYPSMPL 510        520        530        540        550
          ....|....|....|....|....|....|....|....|....|....|
NOV24b    VSFGATAILAGLAVCFLTETRNMPLVETIAAMERR------VK---EGSS
gi|4579723 FIYGAVPVAASAVTVLLPETLGQPLPDTVQDLESRWAPTQKEAGIYPRKG
gi|3831566 FIYGAVPVAASAVTVLLPETLGQPLPDTVQDLES-------------RKG
gi|4759042 FIYGAVPVAASAVTVLLPETLGQPLPDTVQDLES-------------RKG
gi|8393886 FIFGAVPVVASAVTALLPETLGQPLPDTVQDLKSR-----------SRG 560        570
          ....|....|....|....|.
NOV24b    KKHVEEKSEEISLQQLRASPLKETI-
gi|4579723 KQTRQQQEHQKYMVPLQASAQEKNGL
gi|3831566 KQTRQQQEHQKYMVPLQASAQEKNGF
gi|4759042 KQTRQQQEHQKYMVPLQASAQEKNGL
gi|8393886 KQNQQQQEQQKMMPLQASTQEKNGL
```

The presence of identifiable domains in the NOV24 proteins disclosed herein was 60 determined by searches using algorithms such as PROSITE, Blocks, Pfam, Pro-Domain, Prints and then determining the Interpro number by crossing the domain match (or numbers) using the Interpro website (http:www.ebi.ac.uk/interpro/). The DOMAIN results are listed in Table 24L and Table 24M with the statistics and domain description. This indicates that the NOV24 sequences have properties similar to those of other proteins known to contain these domains.

TABLE 24L

Domain Analysis of NOV24a

| Model | Region of Homology | Score (bits) | E value |
|---|---|---|---|
| Sugar transporter | 123–537 | 6.5 | 2.8e-08 |
| Reduced folate carrier | 130–498 | −221.7 | 0.9 |
| Cell cycle protein | 277–529 | −241.8 | 0.95 |

TABLE 24M

Domain Analysis of NOV24b

| Model | Region of Homology | Score (bits) | E value |
|---|---|---|---|
| Sugar transporter | 107–520 | 8.1 | 2.5e-08 |
| Reduced folate carrier | 118–481 | −220.8 | 0.81 |
| Cell cycle protein | 260–512 | −242.8 | 0.95 |

Consistent with other known members of the OAT family of proteins, NOV24 has, for example, sugar transporter domain and homology to other members of the OAT Protein family. NOV24 nucleic acids, and the encoded polypeptides, according to the invention are useful in a variety of applications and contexts. For example, NOV24 nucleic acids and polypeptides can be used to identify proteins that are members of the OAT family of proteins. The NOV24 nucleic acids and polypeptides can also be used to screen for molecules, which inhibit or enhance NOV24 activity or function. Specifically, the nucleic acids and polypeptides according to the invention may be used as targets for the identification of small molecules that modulate or inhibit, e.g., molecular transport. These molecules can be used to treat, e.g., cancer, immune disorders, and kidney disorders.

In addition, various NOV24 nucleic acids and polypeptides according to the invention are useful, inter alia, as novel members of the protein families according to the presence of domains and sequence relatedness to previously described proteins. It is known that many members of the organic anion transporter (OAT), organic cation transporter (OCT), and organic anion-transporting polypeptide (oatp) gene families mediate the transport of diverse organic anions and cations. It has also been suggested that ATP-dependent primary active transporters such as MDR1/P-glycoprotein and the multidrug resistance-associated protein (MRP) gene family function as efflux pumps of renal tubular cells for more hydrophobic molecules and anionic conjugates.

A number transporters, such as the p-aminohippurate/dicarboxylate exchanger OAT1 the anion/sulfate exchanger SAT1, the peptide transporters PEPT1 and PEPT2, and the nucleoside transporters CNT1 and CNT2, are key proteins in organic anion handling that possess the same characteristics as has been predicted from previous physiological studies. The role of other cloned transporters, such as MRP1, MRP2, OATP1, OAT-K1, and OAT-K2, is still poorly characterized, whereas the only information that is available on the homologs OAT2, OAT3, OATP3, and MRP3–6 is that they are expressed in the kidney, but their localization, not to mention their function, remains to be elucidated.

The organic anion transporter 3 belongs to sugar transporter family. The sugar transporters belong to a family of membrane proteins responsible for the transport of various sugars in a wide range of prokaryotic and eukaryotic organisms. These integral membrane proteins are predicted to comprise twelve membrane spanning domains. It is likely that the transporters have evolved from an ancient protein present in living organisms before the divergence into prokaryotes and eukaryotes. In mammals, these proteins are expressed in a number of organs.

The NOV24 nucleic acids and polypeptides, antibodies and related compounds according to the invention will be useful in therapeutic and diagnostic applications in the mediation of molecular transport. As such the NOV24 nucleic acids and polypeptides, antibodies and related compounds according to the invention may be used to treat a wide range of disorders such as cancer, kidney disorders, immune disorders and other diseases, e.g., Von Hippel-Lindau (VHL) syndrome, Cirrhosis, Transplantation, Osteoporosis, Hypercalceimia, Arthritis, Ankylosing spondylitis, Scoliosis, Diabetes, Autoimmune disease, Renal artery stenosis, Interstitial nephritis, Glomerulonephritis, Polycystic kidney disease, Systemic lupus erythematosus, Renal tubular acidosis, IgA nephropathy, Lesch-Nyhan syndrome renal malfunction, nephrotoxicity, disease associated with cytotoxic drug, osteoporosis, osteopetrosis resistance, liver diseases, and heart diseases.

The NOV24 nucleic acids and polypeptides are useful for detecting specific cell types. For example, expression analysis has demonstrated that a NOV24 nucleic acid is expressed in Bone Marrow, Kidney, Intestine, Liver membrane, adrenal gland, bone marrow, brain amygdala, brain—cerebellum, brain—hippocampus, brain—substantia nigra, brain—thalamus, brain—whole, fetal brain, fetal kidney, fetal liver, fetal lung, heart, kidney, lymphoma—Raji, mammary gland, pancreas, pituitary gland, placenta, prostate, salivary gland, skeletal muscle, small intestine, spinal cord, spleen, stomach, testis, thyroid, trachea and uterus.

Additional utilities for NOV24 nucleic acids and polypeptides according to the invention are disclosed herein.

NOV25

A NOV25 polypeptide has been identified as a Ficolin-like protein. Eight alternative novel NOV25, NOV25a, NOV25b, NOV25c, NOV25d, NOV25e, NOV25f, NOV25g, and NOV25h, nucleic acids and encoded polypeptides are provided. The novel NOV25 nucleic acid sequences maps to the chromosome 9q34.

NOV25a

A NOV25 variant is the novel NOV25a (alternatively referred to herein as 152736829), which includes the 1082 nucleotide sequence (SEQ ID NO:82) shown in Table 25A. NOV25a sequence was cloned by polymerase chain reaction (PCR) using the following primers: GCTCGCTGTCCT-GCTAGTCTTGTT (SEQ ID NO:278) and AGAAACAT-AATTCTCCCTCTGGTGAGG (SEQ ID NO:279) on the following pool of human cDNAs: Pool 1—Adrenal gland, bone marrow, brain—amygdala, brain—cerebellum, brain—hippocampus, brain—substantia nigra, brain—thalamus, brain—whole, fetal brain, fetal kidney, fetal liver, fetal lung, heart, kidney, lymphoma—Raji, mammary gland, pancreas, pituitary gland, placenta, prostate, salivary gland, skeletal muscle, small intestine, spinal cord, spleen, stomach, testis, thyroid, trachea, uterus. A NOV25a ORF begins with a ATG initiation codon at nucleotides 16–18 and ends with a TAG codon at nucleotides 928–930. Putative untranslated regions upstream from the initiation codon and downstream from the termination codon are underlined in Table 25A, and the start and stop codons are in bold letters.

NOV25b

Alternatively, a NOV25 variant is the novel NOV25b (alternatively referred to herein as CG56653-02), which includes the 1332 nucleotide sequence (SEQ ID NO:84) shown in Table 25C. NOV25b was cloned by polymerase

TABLE 25A

NOV25a Nucleotide Sequence (SEQ ID NO: 82)

CTGAGTGGAGCCACCATGGCCCGGGGGCTCGCTGTCCTGCTAGTCTTGTTCCTGCATATCAAGAACC
TGCCTGCCCAGGCTGCGGACACATGTCCAGAGGTGAAGGTGGTGGGCCTGGAGGGCTCTGACAAGCT
CACCATTCTCCGAGGCTGCCCGGGGCTGCCCGGGGCCCCAGGGCCAAAGGGAGAGGCAGGTGTCATT
GGAGAGAGAGGAGAACGCGGTCTCCCTGGAGCCCCTGGAAAGGCAGGACCAGTGGGGCCCAAAGGAG
ACCGAGGAGAGAAGGGGATGCGTGGAGAGAAAGGAGACGCTGGGCAGTCTCAGTCGTGTGCGACAGG
CCCACGCAACTGCAAGGACCTGCTAGACCGGGGGTATTTCCTGAGCGGCTGGCACACCATCTACCTG
CCCGACTGCCGGCCCCTGACTGTGCTCTGTGACATGGACACGGACGGAGGGGGCTGGACCGTTTTCC
AGCGGAGGATGGATGGCTCTGTGGACTTCTATCGGGACTGGGCCGCATACAAGCAGGGCTTCGGCAG
TCAGCTGGGGGAGTTCTGGCTGGGGAACGACAACATCCACGCCCTGACTGCCCAGGGAAGCAGCGAG
CTCCGTGTAGACCTGGTGGACTTTGAGGGCAACCACCAGTTTGCTAAGTACAAATCATTCAAGGTGG
CTGACGAGGCAGAGAAGTACAAGCTGGTACTGGGAGCCTTTGTCGGGGGCAGTGCGGACCAAGACAA
TGATGTGAGTTCTTCGAATTGTGCTGAGAAGTTCCAGGGAGCCTGGTGGTACGCCGACTGTCATGCT
TCAAACCTCAATGGTCTCTACCTCATGGGACCCCATGAGAGCCATGCCAATGGTATCAACTGGAGTG
CGGCGAAGGGGTACAAATATAGCTACAAGGTGTCAGAGATGAAGGTGCGGCCCGCCTAGACGGGCCA
GGACCCCTCCACATGCACCTGCTAGTGGGGAGGCCACACCCACAAGCGCTGCGTCGTGGAAGTCACC
CCATTTCCCCAGCCAGACACACTCCCATGACGCCCACAGCTGCCCCTTTGCCCCCAGCTCAGTCAAG
CCGCCACATG

The NOV25a polypeptide (SEQ ID NO:83) encoded by SEQ ID NO:82 is 304 amino acid residues in length and is presented using the one-letter amino acid code in Table 25B. NOV25a has one SNP variant, whose variant position for its nucleotide and amino acid sequences is numbered according to SEQ ID NOS:82 and 83, respectively. A variant sequence can include a single nucleotide polymorphism (SNP). A SNP can, in some instances, be referred to as a "cSNP" to denote that the nucleotide sequence containing the SNP originates as a cDNA. NOV25a Variant 13374708 is a G to A SNP at 774 bp of the nucleotide sequence that results in no change in the protein sequence (silent).

The Psort profile for the NOV25a predicts that this peptide is likely to be localized extracellularly with a certainty of 0.0.4944. The Signal P predicts a likely cleavage site for a NOV25a peptide is between positions 22 and 23, i.e., at the dash in the sequence AQA-AD.

chain reaction (PCR) using the following primers: GCTCGCTGTCCTGCTAGTCTTGTT (SEQ ID NO:280) and AGAAACATAATTCTCCCTCTGGTGAGG (SEQ ID NO:281) on the following pool of human cDNAs: Pool 1—Adrenal gland, bone marrow, brain—amygdala, brain—cerebellum, brain—hippocampus, brain—substantia nigra, brain—thalamus, brain—whole, fetal brain, fetal kidney, fetal liver, fetal lung, heart, kidney, lymphoma—Raji, mammary gland, pancreas, pituitary gland, placenta, prostate, salivary gland, skeletal muscle, small intestine, spinal cord, spleen, stomach, testis, thyroid, trachea, uterus. The NOV25b ORF begins with a Kozak consensus ATG initiation codon at nucleotides 183–185 and ends with a TAG codon at nucleotides 1107–1109. Putative untranslated regions upstream from the initiation codon and downstream from the termination codon are underlined in Table 25C, and the start and stop codons are in bold letters.

TABLE 25B

NOV25a protein sequence (SEQ ID NO: 83)

MARGLAVLLVLFLHIKNLPAQAADTCPEVKVVGLEGSDKLTILRGCPGLPGAPGPKGEAGVIGERGE
RGLPGAPGKAGPVGPKGDRGEKGMRGEKGDAGQSQSCATGPRNCKDLLDRGYFLSGWHTIYLPDCRP
LTVLCDMDTDGGGWTVFQRRMDGSVDFYRDWAAYKQGFGSQLGEFWLGNDNIHALTAQGSSELRVDL
VDFEGNHQFAKYKSFKVADEAEKYKLVLGAFVGGSADQDNDVSSSNCAEKFQGAWWYADCHASNLNG
LYLMGPHESHANGINWSAAKGYKYSYKVSEMKVRPA

TABLE 25C

NOV25b Nucleotide Sequence (SEQ ID NO: 84)

<u>TTTTAGGTCTGTTTGTCGTAGGCAGATGGAGCTTGTTATAATTATGCCTCATAGGGATAGTACAAGG
AAGGGGTAGGCTATGTGTTTTGTCAGGGAGTTGAGAAACTGTGGCACAAGGCGAGAGCTGGTTTCCT
CTGCCCTGTTAGAGCTGGGGGACTCTTCAGCGTCAAAGGCCAGAGAGC</u>ATGGAGCTGAGTGGAGCCA
CCATGGCCCGGGGGCTCGCTGTCCTGCTAGTCTTGTTCCTGCATATCAAGAACCTGCCTGCCCAGGC
TGCCGGACACATGTCCAGAGGTGAAGGTGGTGGGCCTGGAGGGCTCTGGCAAGCTCACCATTCTCCGA
GGCTGCCCGGGGCTGCCCGGGGCCCCAGGGCCAAAGGGAGAGGCAGGTGTCATTGGAGAGAGAGGAG
ACCGAGGAGAGAAGGGGATGCGTGGAGAGAAAGGAGACGCTGGGCAGTCTCAGTCGTGTGCGACAGG
CCCACGCAACTGCAAGGACCTGCTAGACCGGGGGTATTTCCTGAGCGGCTGGCACACCATCTACCTG
CCCGACTGCCGGCCCCTGACTGTGCTCTGTGACATGGACACGGACGGAGGGGGCTGGACCGTTTTCC
AGCGGAGGATGGATGGCTCTGTGGACTTCTATCGGGACTGGGCCGCATACAAGCAGGGCTTCGGCAG
TCAGCTGGGGGAGTTCTGGCTGGGGAATGACAACATCCACGCCCTGACTGCCCAGGGAAGCAGCGAG
CTCCGTGTAGACCTGGTGGACTTTGAGGGCAACCACCAGTTTGCTAAGTACAAATCATTCAAGGTGG
CTGACGAGGCAGAGAAGTACAAGCTGGTACTGGGAGCCTTTGTCGGGGGCAGTGCGGGTAATTCTCT
AACGGGCCACAACAACAACTTCTTCTCCACCAAAGACCAAGACAATGATGTGAGTTCTTCGAATTGT
GCTGAGAAGTTCCAAGGAGCCTGGTGGTACGCCGACTGTCATGCTTCAAACCTCAATGGTCTCTACC
TCATGGGACCCCATGAGAGCTATGCCAATGGTATCAACTGGAGTGCGGCGAAGGGGTACAAATATAG
CTACAAGGTGTCAGAGATGAAGGTGCGGCCCGCCTAG<u>ACGGGCCAGGACCCCTCCACATGCACCTGC
TAGTGGGGAGGCCACACCCACAAGCGCTGCGTCGTGGAAGTCACCCCATTTCCCCAGCCAGACACAC
TCCCATGACGCCCACAGCTGCCCCTTTGCCCCCAGCTCAGTCAAGCCGCCACATGCCCACAACCTCA
CCAGAGGGAGAATTATGTTTCTAAATATGTTTACTTTTGGGGACAGAAAAAAAAAAAAAA</u>

The NOV25b protein (SEQ ID NO:85) encoded by SEQ ID NO:84 is 308 amino acid residues in length is presented using the one-letter code in Table 25D. The Psort profile for NOV25b predicts that this sequence is likely to be localized extracellularly with a certainty of 0.4500. The Signal P predicts a likely cleavage site for a NOV25b peptide is between positions 29 and 30, i.e., at the dash in the sequence AQA-AD.

full length or some portion (one or more exons) of the cDNA/protein sequence of the invention. These primers were used to amplify a cDNA from a pool containing expressed human sequences derived from the following tissues: adrenal gland, bone marrow, brain—amygdala, brain—cerebellum, brain—hippocampus, brain—substantia nigra, brain—thalamus, brain—whole, fetal brain, fetal kidney, fetal liver, fetal lung, heart, kidney, lymphoma—Raji,

TABLE 25D

NOV25b protein sequence (SEQ ID NO: 85)

MELSGATMARGLAVLLVLFLHIKNLPAQAADTCPEVKVVGLEGSGKLTILRGCPGLPGAPGPKGEAG
VIGERGDRGEKGMRGEKGDAGQSQSCATGPRNCKDLLDRGYFLSGWHTIYLPDCRPLTVLCDMDTDG
GGWTVFQRRMDGSVDFYRDWAAYKQGFGSQLGEFWLGNDNIHALTAQGSSELRVDLVDFEGNHQFAK
YKSFKVADEAEKYKLVLGAFVGGSAGNSLTGHNNNFFSTKDQDNDVSSSNCAEKFQGAWWYADCHAS
NLNGLYLMGPHESYANGINWSAAKGYKYSYKVSEMKVRPA

NOV25c

Alternatively, a NOV25 variant is the novel NOV25c (alternatively referred to herein as CG56653-03), which includes the 728 nucleotide sequence (SEQ ID NO:86) shown in Table 25E. NOV25c was cloned by the polymerase chain reaction (PCR) using the primers: 5' GCTCGCTGTC-CTGCTAGTCTTGTT 3' (SEQ ID NO:282) and 5' AGAAA-CATAATTCTCCCTCTGGTGAGG 3' (SEQ ID NO:283). Primers were designed based on in silico predictions of the mammary gland, pancreas, pituitary gland, placenta, prostate, salivary gland, skeletal muscle, small intestine, spinal cord, spleen, stomach, testis, thyroid, trachea and uterus. The NOV25c ORF begins with an ORF identified at nucleotides 1–2 and ends with a TAG codon at nucleotides 574–576. Putative untranslated regions upstream from the initiation codon and downstream from the termination codon are underlined in Table 25E, and the start and stop codons are in bold letters.

TABLE 25E

NOV25c Nucleotide Sequence (SEQ ID NO: 86)

CTGCATATCAAGAACCTGCCTGCCCAGGCTGCGGACACATGTCCAGAGGTGAAGGTGGTGGGCCTGG
AGGGCTCTGACAAGCTCACCATTCTCCGAGGCTGCCCGGGGCTGCCCGGGGCCCCAGGGCCAAAGGG
AGAGGCAGGTGTCATTGGAGAGAGAGGAGAACGCGGTCTCCCTGGAGCCCCTGGAAAGGCAGGACCA
GTGGGGCCCAAAGGAGACCGAGGAGAGAAGGGGATGCGTGGAGAGAAAGGAGACGCTGGGCAGTCTC
AGTCGTGTGCGACAGGCCCACGCAACTGCAAGGACCTGCTAGACCGGGGGTATTTCCTGAGCGGCTG
GCACACCATCTACCTGCCCGACTGCCGGCCCCTGACTGTGCTCTGTGACATGGACACGGACGGAGGG
GGCTGGACCGTTTTCCAGGGAGCCTGGTGGTACGCCGACTGTCATGCTTCAAACCTCAATGGTCTCT
ACCTCATGGGACCCCATGAGAGCTATGCCAATGGTATCAACTGGAGTGCGGCGAAGGGGTACAAATA
TAGCTACAAGGTGTCAGAGATGAAGGTGCGGCCCGCCTAG<u>ACGGGCCAGGACCCCTCCACATGCACC
TGCTAGTGGGGAGGCCACACCCACAAGCGCTGCGTCGTGGAAGTCACCCCATTTCCCCAGCCAGACA
CACTCCCATGACGCCCACAGCTGCCCCTTTGCCCCCAGCTCAGTCAAGCCGCCACATG</u>

The NOV25c protein (SEQ ID NO:87) encoded by SEQ ID NO:86 is 191 amino acid residues in length is presented using the one-letter code in Table 25F. The Psort profile for NOV25c predicts that this sequence is likely to be localized in the cytoplasm with a certainty of 0.4500.

TABLE 25F

NOV25c protein sequence (SEQ ID NO: 87)

LHIKNLPAQAADTCPEVKVVGLEGSDKLTILRGCPGLPGAPGPKGEAGVIGERGERGLPGAPGKAGP
VGPKGDRGEKGMRGEKGDAGQSQSCATGPRNCKDLLDRGYFLSGWHTIYLPDCRPLTVLCDMDTDGG
GWTVFQGAWWYADCHASNLNGLYLMGPHESYANGINWSAAKGYKYSYKVSEMKVRPA

NOV25d

Alternatively, a NOV25 variant is the novel NOV25d (alternatively referred to herein as CG56653-04), which includes the 1104 nucleotide sequence (SEQ ID NO:88) shown in Table 25G. NOV25d was cloned by the polymerase chain reaction (PCR). Primers were designed based on in silico predictions of the full length or some portion (one or more exons) of the cDNA/protein sequence of the invention. These primers were used to amplify a cDNA from a pool containing expressed human sequences derived from the following tissues: adrenal gland, bone marrow, brain—amygdala, brain—cerebellum, brain—hippocampus, brain—substantia nigra, brain—thalamus, brain—whole, fetal brain, fetal kidney, fetal liver, fetal lung, heart, kidney, lymphoma—Raji, mammary gland, pancreas, pituitary gland, placenta, prostate, salivary gland, skeletal muscle, small intestine, spinal cord, spleen, stomach, testis, thyroid, trachea and uterus. The NOV25d ORF begins with a Kozak consensus ATG initiation codon at nucleotides 16–18 and ends with a TAG codon at nucleotides 883–885. Putative untranslated regions upstream from the initiation codon and downstream from the termination codon are underlined in Table 25G, and the start and stop codons are in bold letters.

TABLE 25G

NOV25d Nucleotide Sequence (SEQ ID NO: 88)

CTGAGTGGAGCCACCATGGCCCGGGGGCTCGCTGTCCTGCTAGTCTTGTTCCTGCATATCACGAACC
TGCCTGCCCAGGCTGCGGACACATGTCCAGAGGTGAAGGTGGTGGGCCTGGAGGGCTCTGACAAGCT
CACCATTCTCCGAGGCTGCCCGGGGCTGCCCGGGGCCCCAGGACCAAAGGGAGAGGCAGGTGTCATT
GGAGAGAAAGGAGACGCTGGGCAGTCTCAGTCGTGTGCGACAGGCCCACGCAACTGCAAGGACCTGC
TAGACCGAGGGTATTTCCTGAGCGGCTGGCACACCATCTACCTGCCCGACTGCCGGCCCCTTACTGT
GCTCTGTGACATGGATACGGACGGAGGGGGCTGGACCGTTTTCCAGCGGAGGATGGATGGCTCTGTG
GACTTCTATCGGGACTGGGCCGCATACAAGCAGGGCTTCGGCAGTCAGCTGGGGGAGTTCTGGCTGG
GGAATGACAACATCCACGCCCTGACTGCCCAGGGAAGCAGCGAGCTCCGTGTAGACCTGGTGGACTT
TGAGGGCAACCACCAGTTTGCTAAGTACAAATCATTCAAGGTGGCTGACGAGGCAGAGAAGTACAAG
CTGGTACTGGGAGCCTTTGTCGGGGGCAGTGCGGGTAATTCTCTAACGGGCCACAACAACAACTTCT
TCTCCACCAAAGACCAAGACAATGATGTGAGTTCTTCGAATTGTGCTGAGAAGTTCCAGGGAGCCTG
GTGGTACGCCGACTGTCATGCTTCAAACCTCAATGGTCTCTACCTCATGGGACCCCATGAGAGCTAT
GCCAATGGTATCAACTGGAGTGCGGCGAAGGGGTACAAATATAGCTACAAGGTGTCAGAGATGAAGG
TGCGGCCCGCCTAGACGGGCCAGGACCCCTCCACATGCACCTGCTAGTGGGGAGGCCACACCCACAA
GCGCTGCGTCGTGGAAGTCACCCCATTTCCCCAGCCAGACACACTCCCATGACGCCCACAGCTGCCC
CTTTGCCCCCAGCTCAGTCAAGCCGCCACATGCCCACAACCTCACCAGAGGGAGAATTATGTTTCTA
AATATGTTTACTTTGGGACAGAAAAAAAAAAA

The NOV25d protein (SEQ ID NO:89) encoded by SEQ ID NO:88 is 289 amino acid residues in length is presented using the one-letter code in Table 25H. The Psort profile for NOV25d predicts that this sequence is likely to be localized extracellularly with a certainty of 0.6472. The Signal P predicts a likely cleavage site for a NOV25d peptide is between positions 22 and 23, i.e., at the dash in the sequence AQA-AD.

TABLE 25H

NOV25d protein sequence (SEQ ID NO: 89)

MARGLAVLLVLFLHITNLPAQAADTCPEVKVVGLEGSDKLTILRGCPGLPGAPGPKGEAGVIGEKGD
AGQSQSCATGPRNCKDLLDRGYFLSGWHTIYLPDCRPLTVLCDMDTDGGGWTVFQRRMDGSVDFYRD
WAAYKQGFGSQLGEFWLGNDNIHALTAQGSSELRVDLVDFEGNHQFAKYKSFKVADEAEKYKLVLGA
FVGGSAGNSLTGHNNNFFSTKDQDNDVSSSNCAEKFQGAWWYADCHASNLNGLYLMGPHESYANGIN
WSAAKGYKYSYKVSEMKVRPA

NOV25e

Alternatively, a NOV25 variant is the novel NOV25e (alternatively referred to herein as CG56653-06), which includes the 988 nucleotide sequence (SEQ ID NO:90) shown in Table 25I. NOV25e was cloned by the polymerase chain reaction (PCR) using the primers: 5'GTTTTGT-CAGGGAGTTGAGAAACTGTG 3' (SEQ ID NO:284) and 5' GAAATGGGGTGACTTCCACGAC 3' (SEQ ID NO:285). Primers were designed based on in silico predictions of the full length or some portion (one or more exons) of the cDNA/protein sequence of the invention. These primers were used to amplify a cDNA from a pool containing expressed human sequences derived from the following tissues: adrenal gland, bone marrow, brain—amygdala, brain—cerebellum, brain—hippocampus, brain—substantia nigra, brain thalamus, brain—whole, fetal brain, fetal kidney, fetal liver, fetal lung, heart, kidney, lymphoma Raji, mammary gland, pancreas, pituitary gland, placenta, prostate, salivary gland, skeletal muscle, small intestine, spinal cord, spleen, stomach, testis, thyroid, trachea and uterus. The NOV25e ORF begins with a Kozak consensus ATG initiation codon at nucleotides 56–58 and ends with a TAG codon at nucleotides 905–907. Putative untranslated regions upstream from the initiation codon and downstream from the termination codon are underlined in Table 25I, and the start and stop codons are in bold letters.

TABLE 25I

NOV25e Nucleotide Sequence (SEQ ID NO: 90)

GTTTCCTCTGCCCTGTTAGAGCTGGGGGACTCTTCAGAGTCAAAGGCCAGAGAGCATGGAGCTGAGT
GGAGCCACCATGGCCCGGGGGCTCGCTGTCCTGCTAGTCTTGTTCCTGCATATCAAGAACCTGCCTG
CCCAGGCTGCGGACACATGTCCAGAGGTGAAGGTGGTGGGCCTGGAGGGCTCTGACAAGCTCACCAT
TCTCCGAGGCTGCCCGGGGCTGCCCGGGGCCCCAGGGCCAAAGGGAGAGGCAGGTGTCATTGGAGAG
AGAGGAGAACGCGGTCTCCCTGGAGCCCCTGGAAAGGCAGGACCAGTGGGGCCCAAAGGAGACCGAG
GAGAGAAGGGGATGCGTGGAGAGAAAGGAGACGCTGGGCAGTCTCAGTCGTGTGCGACAGGTCCACG
CAACTGCAAGGACCTGCTAGACCGGGGGTATTTCCTGAGCGGCTGGCACACCATCTACCTGCCCGAC
TGCCGGCCCCTGACTGTGCTCTGTGACATGGACACGGACGGAGGGGGCTGGACCGTTTTCCAGCGGA
GGATGGATGGCTCTGTGGACTTTGAGGGCAACCACCAGTTTGCTAAGTACAAATCATTCAAGGTGGC
TGACGAGGCAGAGAAGTACAAGCTGGTACTGGGAGCCTTTGTCGGGGGCAGTGCGGGTAATTCTCTA
ACGGGCCACAACAACAACTTCTTCTCCACCAAAGACCAAGACAATGATGTGAGTTCTTCGAATTGTG
CTGAGAAGTTCCAAGGAGCCTGGTGGTACGCCGACTGTCATGCTTCAAACCTCAATGGTCTCTACCT
CATGGGACCCCATGAGAGCTATGCCAATGGTATCAACTGCAGTGCGGCGAAGGGGTACAAATATAGC
TACAAGGTGTCAGAGATGAAGGTGCGGCCCGCCTAGACGGGCCAGGACCCCTCCACATGCACCTGCT
AGTGGGGAGGCCACACCCACAAGCGCTGCGTCGTGGAAGTCACCCATTTC

The NOV25e protein (SEQ ID NO:91) encoded by SEQ ID NO:90 is 283 amino acid residues in length is presented using the one-letter code in Table 25J. A variant sequence can include a single nucleotide polymorphism (SNP). A SNP can, in some instances, be referred to as a "cSNP" to denote that the nucleotide sequence containing the SNP originates as a cDNA. A NOV24b Variant is a G to T SNP at 89 bp of the nucleotide sequence.

The Psort profile for NOV25e predicts that this sequence is likely to be localized extracellularly with a certainty of 0.6711. The Signal P predicts a likely cleavage site for a NOV25e peptide is between positions 29 and 30, i.e., at the dash in the sequence AQA-AD.

TABLE 25J

NOV25e protein sequence (SEQ ID NO: 91)

MELSGATMARGLAVLLVLFLHIKNLPAQAADTCPEVKVVGLEGSDKLTILRGCPGLPGAPGPKGEAG
VIGERGERGLPGAPGKAGPVGPKGDRGEKGMRGEKGDAGQSQSCATGPRNCKDLLDRGYFLSGWHTI
YLPDCRPLTVLCDMDTDGGGWTVFQRRMDGSVDFEGNHQFAKYKSFKVADEAEKYKLVLGAFVGGSA
GNSLTGHNNNFFSTKDQDNDVSSSNCAEKFQGAWWYADCHASNLNGLYLMGPHESYANGINCSAAKG
YKYSYKVSEMKVRPA

NOV25f

Alternatively, a NOV25 variant is the novel NOV25f (alternatively referred to herein as CG56653-01), which includes the 1194 nucleotide sequence (SEQ ID NO:92) shown in Table 25K. The NOV25f ORF begins with a Kozak consensus ATG initiation codon at nucleotides 15–18 and ends with a TAG codon at nucleotides 973–975. Putative untranslated regions upstream from the initiation codon and downstream from the termination codon are underlined in Table 25K, and the start and stop codons are in bold letters.

NOV25g

Alternatively, a NOV25 variant is the novel NOV25g (alternatively referred to herein as CG56653-09), which includes the 1144 nucleotide sequence (SEQ ID NO:94) shown in Table 25M. NOV25g was derived by laboratory cloning of cDNA fragments, by in silico prediction of the sequence. cDNA fragments covering either the full length of the DNA sequence, or part of the sequence, or both, were cloned. In silico prediction was based on sequences available in Curagen's proprietary sequence databases or in the public human sequence databases, and provided either the fall length DNA sequence, or some portion thereof. The NOV25g ORF begins with a Kozak consensus ATG initiation codon at nucleotides 183–185 and ends with a TAG codon at nucleotides 981–983. Putative untranslated regions upstream from the initiation codon and downstream from the termination codon are underlined in Table 25M, and the start and stop codons are in bold letters.

TABLE 25K

NOV25f Nucleotide Sequence (SEQ ID NO:92)

CTGAGTGGAGCCACCATGGCCCGGGGGCTCGCTGTCCTGCTAGTCTTGTTCCTGCATATCAAGAACC
TGCCTGCCCAGGCTGCGGACACATGTCCAGAGGTGAAGGTGGTGGGCCTGGAGGGCTCTGACAAGCT
CACCATTCTCCGAGGCTGCCCGGGGCTGCCCGGGGCCCCAGGGCCAAAGGGAGAGGCAGGTGTCATT
GGAGAGAGAGGAGAACGCGGTCTCCCTGGAGCCCCTGGAAAGGCAGGACCAGTGGGGCCCAAAGGAG
ACCGAGGAGAGAAGGGGATGCGTGGAGAGAAAGGAGACGCTGGGCAGTCTCAGTCGTGTGCGACAGG
CCCACGCAACTGCAAGGACCTGCTAGACCGGGGGTATTTCCTGAGCGGCTGGCACACCATCTACCTG
CCCGACTGCCGGCCCCTGACTGTGCTCTGTGACATGGACACGGACGGAGGGGGCTGGACCGTTTTCC
AGCGGAGGATGGATGGCTCTGTGGACTTCTATCGGGACTGGGCCGCATACAAGCAGGGCTTCGGCAG
TCAGCTGGGGGAGTTCTGGCTGGGGAACGACAACATCCACGCCCTGACTGCCCAGGGAAGCAGCGAG
CTCCGTGTAGACCTGGTGGACTTTGAGGGCAACCACCAGTTTGCTAAGTACAAATCATTCAAGGTGG
CTGACGAGGCAGAGAAGTACAAGCTGGTACTGGGAGCCTTTGTCGGGGGCAGTGCGGGTAATTCTCT
AACGGGCCACAACAACAACTTCTTCTCCACCAAAGACCAAGACAATGATGTGAGTTCTTCGAATTGT
GCTGAGAAGTTCCAGGGAGCCTGGTGGTACGCCGACTGTCATGCTTCAAACCTCAATGGTCTCTACC
TCATGGGACCCCATGAGAGCTATGCCAATGGTATCAACTGGAGTGCGGCGAAGGGGTACAAATATAG
CTACAAGGTGTCAGAGATGAAGGTGCGGCCCGCCTAGACGGGCCAGGACCCCTCCACATGCACCTGC
TAGTGGGGAGGCCACACCCACAAGCGCTGCGTCGTGGAAGTCACCCCATTTCCCCAGCCAGACACAC
TCCCATGACGCCCACAGCTGCCCCTTTGCCCCCAGCTCAGTCAAGCCGCCACATGCCCACAACCTCA
CCAGAGGGAGAATTATGTTTCTAAATATGTTTACTTTGGGACAGAAAAAAAAAAAA

The NOV25f protein (SEQ ID NO:93) encoded by SEQ ID NO:92 is 319 amino acid residues in length is presented using the one-letter code in Table 25L. The Psort profile for NOV25f predicts that this sequence is likely to be localized extracellularly with a certainty of 0.4944.

TABLE 25L

NOV25f protein sequence (SEQ ID NO:93)

MARGLAVLLVLFLHIKNLPAQAADTCPEVKVVGLEGSDKLTILRGCPGLPGAPGPKGEAGVIGERGE
RGLPGAPGKAGPVGPKGDRGEKGMRGEKGDAGQSQSCATGPRNCKDLLDRGYFLSGWHTIYLPDCRP
LTVLCDMDTDGGGWTVFQRRMDGSVDFYRDWAAYKQGFGSQLGEFWLGNDNIHALTAQGSSELRVDL
VDFEGNHQFAKYKSFKVADEAEKYKLVLGAFVGGSAGNSLTGHNNNFFSTKDQDNDVSSSNCAEKFQ
GAWWYADCHASNLNGLYLMGPHESYANGINWSAAKGYKYSYKVSEMKVRPA

TABLE 25M

NOV25g Nucleotide Sequence (SEQ ID NO:94)

TTTTAGGTCTGTTTGTCGTAGGCAGATGGAGCTTGTTTATAATTATGCCTCATAGGGATAGTACAAGG
AAGGGGTAGGCTATGTGTTTTGTCAGGGAGTTGAGAAACTGTGGCACAAGGCGAGAGCTGGTTTCCT
CTGCCCTGTTAGAGCTGGGGGACTCTTCAGAGTCAAAGGCCAGAGAGCATGGAGCTGAGTGGAGCCA
CCATGGCCCGGGGGCTCGCTGTCCTGCTAGTCTTGTTCCTGCATATCAAGAACCTGCCTGCCCAGGC
TGCCGGACACATGTCCAGAGGTGAAGGTGGTGGGCCTGGAGGGCTCTGACAAGCTCACCATTCTCCGA
GGCTGCCCGGGGCTGCCCGGGGCCCCAGGGCCAAAGGGAGAGGCAGGTGTCATTGGAGAGAGGAG
AACGCGGTCTCCCTGGAGCCCCTGGAAAGGCAGGACCAGTGGGGCCCAAAGGAGACCGAGGAGAGAA
GGGGATGCGTGGAGAGAAAGGAGACGCTGGGCAGTCTCAGTCGTGTGCGACAGGCCCACGCAACTGC
AAGGACCTGCTAGACCGGGGGTATTTCCTGAGCGGCTGGCACACCATCTACCTGCCCGACTGCCGGC
CCCTGACTGTGCTCTGTGACATGGACACGGACGGAGGGGGCTGGACCGTTTTCCAGCGGAGGATGGA
TGGCTCTGTGGACTTCTATCGGGACTGGGCCGCATACAAGCAGGGCTTCGGCAGTCAGCTGGGGGGT
AATTCTCTAACGGGCCACAACAACAACTTCTTCTCCACCAAAGACCAAGACAATGATGTGAGTTCTT
CGAATTGTGCTGAGAAGTTCCAAGGAGCCTGGTGGTACGCCGACTGTCATGCTTCAAACCTCAATGG
TCTCTACCTCATGGGACCCCATGAGAGCTATGCCAATGGTATCAACTGGAGTGCGGCGAAGGGGTAC
AAATATAGCTACAAGGTGTCAGAGATGAAGGTGCGGCCCGCCTAGACGGGCCAGGACCCCTCCACAT
GCACCTGCTAGTGGGGAGGCCACACCCACAAGCGCTGCGTCGTGGAAGTCACCCCATTTCCCCAGCC
AGACACACTCCCATGACGCCCACAGCTGCCCCTTTGCCCCCAGCTCAGTCAAGCCGCCACATGCCCA
CAACC

The NOV25g protein (SEQ ID NO:95) encoded by SEQ ID NO:94 is 266 amino acid residues in length is presented using the one-letter code in Table 25N. The Psort profile for NOV25g predicts that this sequence is likely to be localized extracellularly with a certainty of 0.6711. The Signal P predicts a likely cleavage site for a NOV25g peptide is between positions 29 and 30, i.e., at the dash in the sequence AQA-AD.

TABLE 25N

NOV25g protein sequence (SEQ ID NO:95)

MELSGATMARGLAVLLVLFLHIKNLPAQAADTCPEVKVVGLEGSDKLTILRGCPGLPGAPGPKGEAG
VIGERGERGLPGAPGKAGPVGPKGDRGEKGMRGEKGDAGQSQSCATGPRNCKDLLDRGYFLSGWHTI
YLPDCRPLTVLCDMDTDGGGWTVFQRRMDGSVDFYRDWAAYKQGFGSQLGGNSLTGHNNNFFSTKDQ
DNDVSSSNCAEKFQGAWWYADCHASNLNGLYLMGPHESYANGINWSAAKGYKYSYKVSEMKVRPA

NOV25h

Alternatively, a NOV25 variant is the novel NOV25h (alternatively referred to herein as CG56653-01 & CG56653-02 assembly 169319361), which includes the 900 nucleotide sequence (SEQ ID NO:96) shown in Table 25O. The NOV25h ORF begins at nucleotides 1–2 and ends with a TAG codon at nucleotides 898.

TABLE 25O

NOV25h Nucleotide Sequence (SEQ ID NO:96)

GGATCCGCGGACACATGTCCAGAGGTGAAGGTGGTGGGCCTGGAGGGCTCTGACAAGCTCACCATTC
TCCGAGGCTGCCCGGGGCTGCCCGGGGCCCCAGGGCCAAAGGGAGAGGCAGGTGTCATTGGAGAGAG
AGGAGAACGCGGTCTCCCTGGAGCCCCTGGAAAGGCAGGACCAGTGGGGCCCAAAGGAGACCGAGGA
GAGAAGGGGATGCGTGGAGAGAAAGGAGACGCTGGGCAGTCTCAGTCGTGTGCGACAGGCCCACGCA
ACTGCAAGGACCTGCTAGACCGGGGGTATTTCCTGAGCGGCTGGCACACCATCTACCTGCCCGACTG
CCGGCCCCTGACTGTGCTCTGTGACATGGACACGGACGGAGGGGGCTGGACCGTTTTCCAGCGGAGG
ATGGATGGCTCTGTGGACTTCTATCGGGACTGGGCCGCATACAAGCAGGGCTTCGGCAGTCAGCTGG
GGGAGTTCTGGCTGGGGAACGACAACATCCACGCCCTGACTGCCCAGGGAAGCAGCGAGCTCCGTGT
AGACCTGGTGGACTTTGAGGGCAACCACCAGTTTGCTAAGTACAAATCATTCAAGGTGGCTGACGAG
GCAGAGAAGTACAAGCTGGTACTGGGAGCCTTTGTCGGGGGCAGTGCGGGTAATTCTCTAACGGGCC
ACAACAACAACTTCTTCTCCACCAAAGACCAAGACAATGATGTGAGTTCTTCGAATTGTGCTGAGAA
GTTCCAGGGAGCCTGGTGGTACGCCGACTGTCATGCTTCAAACCTCAATGGTCTCTACCTCATGGGA
CCCCATGAGAGCTATGCCAATGGTATCAACTGGAGTGCGGCGAAGGGGTACAAATATAGCTACAAGG
TGTCAGAGATGAAGGGGCCCGCCCTCGAG

The NOV25h protein (SEQ ID NO:97) encoded by SEQ ID NO:96 is 300 amino acid residues in length is presented using the one-letter code in Table 25P. The Psort profile for NOV25h predicts that this sequence is likely to be localized extracellularly with a certainty of 0.4500.

TABLE 25P

NOV25h protein sequence (SEQ ID NO:97)

GSADTCPEVKVVGLEGSDKLTILRGCPGLPGAPGPKGEAGVIGERGERGLPGAPGKAGPVGPKGDRG
EKGMRGEKGDAGQSQSCATGPRNCKDLLDRGYFLSGWHTIYLPDCRPLTVLCDMDTDGGGWTVFQRR
MDGSVDFYRDWAAYKQGFGSQLGEFWLGNDNIHALTAQGSSELRVDLVDFEGNHQFAKYKSFKVADE
AEKYKLVLGAFVGGSAGNSLTGHNNNFFSTKDQDNDVSSSNCAEKFQGAWWYADCHASNLNGLYLMG
PHESYANGINWSAAKGYKYSYKVSEMKGPALE

NOV25 Clones

Unless specifically addressed as NOV25a, NOV25b, NOV25c, NOV25d, NOV25e, NOV25f, NOV25g, or NOV25h, any reference to NOV25 is assumed to encompass all variants. Further, Patp, BLAST, and DOMAIN analyses are presented for NOV25b, the longest NOV25 polypeptide sequence.

A search against the Patp database, a proprietary database that contains sequences published in patents and patent publications, yielded several homologous proteins shown in Table 25Q.

TABLE 25Q

Patp results for NOV25

| Sequences producing High-scoring Segment Pairs: | Reading Frame | High Score | Smallest Sum Prob P(N) |
|---|---|---|---|
| >patp:AAR94183 Human 35 kDa opsonin protein P35 | +1 | 1272 | 2.0e-129 |
| >patp:AAR94179 Human 35 kDa opsonin protein P35 fragment | +1 | 1225 | 1.9e-124 |
| >patp:AAR30971 TGF-beta-1 binding protein | +1 | 1200 | 8.6e-122 |
| >patp:AAR94178 Human 35 kDa opsonin protein P35 fragment | +1 | 1022 | 6.2e-103 |
| >patp:AAB29658 Human membrane-associated protein HUMAP-15 | +1 | 746 | 1.1e-73 |

NOV25 polypeptides are ficolin-like proteins with sequence homology to the Fibrinogen protein family. In a BLAST search of public sequence databases, it was found, for example, that the NOV25b nucleic sequence of this invention has 956 of 982 bases (97%) identical to a gb:GEN-BANK-ID:S80990|acc:S80990.1 mRNA from *Homo sapiens* [ficolin (human, uterus, mRNA, 1736 nt)]. The full NOV25b polypeptide sequence was found to have 252 of 276 amino acid residues (91%) identical to, and 258 of 276 amino acid residues (93%) similar to, the 319 amino acid residue ptnr:SPTREMBL-ACC:Q92596 protein from *Homo sapiens*.

Additional BLAST results are shown in Table 25R.

TABLE 25R

BLAST results for NOV25

| Gene Index/ Identifier | Protein/Organism | Length (aa) | Identity (%) | Positives (%) | Expect |
|---|---|---|---|---|---|
| GI|8051584|REF|NP_0 01994.2| (NM_002003) | FICOLIN 1 PRECURSOR [*Homo sapiens*] | 326 | 307/326 (94%) | 307/326 (94%) | 1e-174 |

TABLE 25R-continued

BLAST results for NOV25

| Gene Index/ Identifier | Protein/Organism | Length (aa) | Identity (%) | Positives (%) | Expect |
|---|---|---|---|---|---|
| GI\|13124165\|SP\|00060 2\| | FCN1_HUMAN FICOLIN 1 PRECURSOR (COLLAGEN/FIBRINO GEN DOMAIN-CONTAINING PROTEIN 1) [Homo sapiens] | 326 | 305/326 (93%) | 306/326 (93%) | 1e−172 |
| GI\|2135117\|PIR\|JC4 942 | FICOLIN-1 PRECURSOR [Homo sapiens] | 319 | 300/319 (94%) | 300/319 (94%) | 1e−170 |
| GI\|423207\|PIR\|B471 72 | FICOLIN-BETA - [Sus scrofa] | 326 | 238/324 (73%) | 264/324 (81%) | 1e−133 |
| GI\|16758442\|REF\|NP_ 446086.1\| (NM_053634) | FICOLIN B [Rattus norvegicus] | 319 | 229/317 (72%) | 255/317 (80%) | 1e−131 |

A multiple sequence alignment is given in Table 25S, with the NOV25 protein of the invention being shown on line 1, in a ClustalW analysis comparing NOV25 with related protein sequences disclosed in Table 25R.

Table 25S. Information for the ClustalW proteins:

1. >NOV25a; SEQ ID NO:83
2. >NOV25b; SEQ ID NO:85
3. >NOV25c; SEQ ID NO:87
4. >NOV25d; SEQ ID NO:89
5. >NOV25e; SEQ ID NO:91
6. >NOV25f; SEQ ID NO:93
7. >NOV25g; SEQ ID NO:95
8. >NOV25h; SEQ ID NO:97
9. >GI|8051584/ FICOLIN 1 PRECURSOR [*Homo sapiens*]; SEQ ID NO:286
10. >GI|1312416/ FCN1_HUMAN FICOLIN 1 PRECURSOR [*Homo sapiens*]; SEQ ID NO:287
11. >GI|2135117/ FICOLIN-1 PRECURSOR *Homo sapiens*]; SEQ ID NO:288
12. >GI|423207|/ FICOLIN-BETA [*Sus scrofa*]; SEQ ID NO:289
13. >GI|1675844/ FICOLIN B [*Rattus norvegicus*]; SEQ ID NO:290

```
            10        20        30        40        50
   ....|....|....|....|....|....|....|....|....|....|
```

```
NOV25a       -------MARGLAVLLVLFLHIKNLPAQAADTCPEVKVVGLEGSDKLTIL
NOV25b       MELSGATMARGLAVLLVLFLHIKNLPAQAADTCPEVKVVGLEGSGKLTIL
NOV25c       --------------------LHIKNLPAQAADTCPEVKVVGLEGSDKLTIL
NOV25d       -------MARGLAVLLVLFLHITNLPAQAADTCPEVKVVGLEGSDKLTIL
NOV25e       MELSGATMARGLAVLLVLFLHIKNLPAQAADTCPEVKVVGLEGSDKLTIL
NOV25f       -------MARGLAVLLVLFLHIKNLPAQAADTCPEVKVVGLEGSDKLTIL
NOV25g       MELSGATMARGLAVLLVLFLHIKNLPAQAADTCPEVKVVGLEGSDKLTIL
NOV25h       ------------------------GSADTCPEVKVVGLEGSDKLTIL
GI|8051584   MELSGATMARGLAVLLVLFLHIKNLPAQAADTCPEVKVVGLEGSDKLTIL
GI|1312416   MELSGATMARGLAVLLVLFLHIKNLPAQAADTCPEVKVVGLEGSDKLTIL
GI|2135117   -------MARGLAVLLVLFLHIKNLPAQAADTCPEVKVVGLEGSDKLTIL
GI|423207|   MELSRVAVALGPTGQLLLFLSFQTLAAQAADTCPEVKVVGLEGSDKLSIL
GI|1675844   -------MVLGSAALFVLSLCVTELTLHAADTCPEVKVLDLEGSNKLTIL 60        70        80        90       100
                ....|....|....|....|....|....|....|....|....|....|
NOV25a       RGCPGLPGAPGPKGEAGVIGERGERGLPGAPGKAGPVGPKGDRGEKGMRG
NOV25b       RGCPGLPGAPGPKGEAGVIGERG----------------DRGEKGMRG
NOV25c       RGCPGLPGAPGPKGEAGVIGERGERGLPGAPGKAGPVGPKGDRGEKGMRG
NOV25d       RGCPGLPGAPGPKGEAGVIGE-----------------------------
NOV25e       RGCPGLPGAPGPKGEAGVIGERGERGLPGAPGKAGPVGPKGDRGEKGMRG
NOV25f       RGCPGLPGAPGPKGEAGVIGERGERGLPGAPGKAGPVGPKGDRGEKGMRG
NOV25g       RGCPGLPGAPGPKGEAGVIGERGERGLPGAPGKAGPVGPKGDRGEKGMRG
NOV25h       RGCPGLPGAPGPKGEAGVIGERGERGLPGAPGKAGPVGPKGDRGEKGMRG
GI|8051584   RGCPGLPGAPGPKGEAGVIGERGERGLPGAPGKAGPVGPKGDRGEKGMRG
GI|1312416   RGCPGLPGAPGPKGEAGVIGERGERGLPGAPGKAGPVGPKGDRGEKGMRG
GI|2135117   RGCPGLPGAPGPKGEAGVIGERGERGLPGAPGKAGPVGPKGDRGEKGMRG
GI|423207|   RGCPGLPGAAGPKGEAGANGPKGERGSPGVVGKAGPAGPKGDRGEKGARG
GI|1675844   QGCPGLPGALGPKGEAGAKGDRGESGLPGHPGKAGPTGPKGDRGEKGVRG 110       120       130       140       150
                ....|....|....|....|....|....|....|....|....|....|
NOV25a       EKGDAGQSQSCATGPRNCKDLLDRGYFLSGWHTIYLPDCRPLTVLCDMDT
NOV25b       EKGDAGQSQSCATGPRNCKDLLDRGYFLSGWHTIYLPDCRPLTVLCDMDT
NOV25c       EKGDAGQSQSCATGPRNCKDLLDRGYFLSGWHTIYLPDCRPLTVLCDMDT
NOV25d       -KGDAGQSQSCATGPRNCKDLLDRGYFLSGWHTIYLPDCRPLTVLCDMDT
NOV25e       EKGDAGQSQSCATGPRNCKDLLDRGYFLSGWHTIYLPDCRPLTVLCDMDT
NOV25f       EKGDAGQSQSCATGPRNCKDLLDRGYFLSGWHTIYLPDCRPLTVLCDMDT
NOV25g       EKGDAGQSQSCATGPRNCKDLLDRGYFLSGWHTIYLPDCRPLTVLCDMDT
NOV25h       EKGDAGQSQSCATGPRNCKDLLDRGYFLSGWHTIYLPDCRPLTVLCDMDT
GI|8051584   EKGDAGQSQSCATGPRNCKDLLDRGYFLSGWHTIYLPDCRPLTVLCDMDT
GI|1312416   EKGDAGQSQSCATGPRNCKDLLDRGYFLSGWHNIYLPDCRPLTVLCDMDT
GI|2135117   EKGDAGQSQSCATGPRNCKDLLDRGYFLSGWHTIYLPDCRPLTVLCDMDT
GI|423207|   EKGEPGQLQSCATGPRTCKELLTRGHFLSGWHTIYLPDCQPLTVLCDMDT
GI|1675844   EKGDTGPSQSCATGPRTCKELLTRGYFLTGWYTIYLPDCRPLTVLCDMDT 160       170       180       190       200
                ....|....|....|....|....|....|....|....|....|....|
NOV25a       DGGGWTVFQRRMDGSVDFYRDWAAYKQGFGSQLGEFWLGNDNIHALTAQG
NOV25b       DGGGWTVFQRRMDGSVDFYRDWAAYKQGFGSQLGEFWLGNDNIHALTAQG
NOV25c       DGGGWTVFQ-----------------------------------------
NOV25d       DGGGWTVFQRRMDGSVDFYRDWAAYKQGFGSQLGEFWLGNDNIHALTAQG
NOV25e       DGGGWTVFQRRMDGSVDFE-------------------------------
NOV25f       DGGGWTVFQRRMDGSVDFYRDWAAYKQGFGSQLGEFWLGNDNIHALTAQG
NOV25g       DGGGWTVFQRRMDGSVDFY-------------------------------
NOV25h       DGGGWTVFQRRMDGSVDFYRDWAAYKQGFGSQLGEFWLGNDNIHALTAQG
GI|8051584   DGGGWTVFQRRMDGSVDFYRDWAAYKQGFGSQLGEFWLGNDNIHALTAQG
GI|1312416   DGGGWTVFQRRMDGSVDFYRDWAAYKQGFGSQLGEFWLGNDNIHALTAQG
GI|2135117   DGGGWTVFQRRMDGSVDFYRDWAAYKQGFGSQLGEFWLGNDNIHALTAQG
GI|423207|   DGGGWTVFQRRSDGSVDFYRDWAAYKRGFGSQLGEFWLGNDHIHALTAQG
GI|1675844   DGGGWTVFQRRIDGTVDFFRDWTSYKQGFGSQLGEFWLGNDNIHALTTQG 210       220       230       240       250
```

401                                                                           402

```
              ....|....|....|....|....|....|....|....|....|....|
NOV25a        SSELRVDLVDFEGNHQFAKYKSFKVADEAEKYKLVLGAFVG---GSA---
NOV25b        SSELRVDLVDFEGNHQFAKYKSFKVADEAEKYKLVLGAFVGGSAGNS---
NOV25c        --------------------------------------------------
NOV25d        SSELRVDLVDFEGNHQFAKYKSFKVADEAEKYKLVLGAFVGGSAGNS---
NOV25e        -----------GNHQFAKYKSFKVADEAEKYKLVLGAFVGGSAGNS---
NOV25f        SSELRVDLVDFEGNHQFAKYKSFKVADEAEKYKLVLGAFVG---GSAGNS
NOV25g        ---------------------RDWAAYKQGFGSQLG---GNS---
NOV25h        SSELRVDLVDFEGNHQFAKYKSFKVADEAEKYKLVLGAFVGGSAGNS---
GI|8051584    SSELRVDLVDFEGNHQFAKYKSFKVADEAEKYKLVLGAFVGGSAGNS---
GI|1312416    SSELRVDLVDFEGNHQFAKYKSFKVADEAEKYKLVLGAFVGGSAGNS---
GI|2135117    SSELRVDLVDFEGNHQFAKYKSFKVADEAEKYKLVLGAFVGGSAGNS---
GI|423207|    TSELRVDLVDFEGNHQFAKYRSFQVAGEAEKYKLVLGGFLEGNAGDS---
GI|1675844    TNELRVDLADFDGNHDFAKYSSFQIQGEAEKYKLILGNFLGGGAGDS---

260       270       280       290       300
              ....|....|....|....|....|....|....|....|....|....|
NOV25a        ------------DQDNDVSSSNCAEKFQGAWWYADCHASNLNGLYLMGPH
NOV25b        LTGHNNNFFSTKDQDNDVSSSNCAEKFQGAWWYADCHASNLNGLYLMGPH
NOV25c        ------------------------GAWWYADCHASNLNGLYLMGPH
NOV25d        LTGHNNNFFSTKDQDNDVSSSNCAEKFQGAWWYADCHASNLNGLYLMGPH
NOV25e        LTGHNNNFFSTKDQDNDVSSSNCAEKFQGAWWYADCHASNLNGLYLMGPH
NOV25f        LTGHNNNFFSTKDQDNDVSSSNCAEKFQGAWWYADCHASNLNGLYLMGPH
NOV25g        LTGHNNNFFSTKDQDNDVSSSNCAEKFQGAWWYADCHASNLNGLYLMGPH
NOV25h        LTGHNNNFFSTKDQDNDVSSSNCAEKFQGAWWYADCHASNLNGLYLMGPH
GI|8051584    LTGHNNNFFSTKDQDNDVSSSNCAEKFQGAWWYADCHASNLNGLYLMGPH
GI|1312416    LTGHNNNFFSTKDQDNDVSSSNCAEKFQGAWWYADCHASSLNGLYLMGPH
GI|2135117    LTGHNNNFFSTKDQDNDVSSSNCAEKFQGAWWYADCHASNLNGLYLMGPH
GI|423207|    LSSHRDQFFSTKDQDNDNHSGNCAEQYHGAWWYNACHSSNLNGRYLRGLH
GI|1675844    LTSQNNMLFSTKDQDNDQGSSNCAVRYHGAWWYSDCHTSNLNGLYLRGLH 310       320       330
              ....|....|....|....|....|....|.
NOV25a        ESHANGINWSAAKGYKYSYKVSEMKVRPA--
NOV25b        ESYANGINWSAAKGYKYSYKVSEMKVRPA--
NOV25c        ESYANGINWSAAKGYKYSYKVSEMKVRPA--
NOV25d        ESYANGINWSAAKGYKYSYKVSEMKVRPA--
NOV25e        ESYANGINCSAAKGYKYSYKVSEMKVRPA--
NOV25f        ESYANGINWSAAKGYKYSYKVSEMKVRPA--
NOV25g        ESYANGINWSAAKGYKYSYKVSEMKVRPA--
NOV25h        ESYANGINWSAAKGYKYSYKVSEMKG-PALE
GI|8051584    ESYANGINWSAAKGYKYSYKVSEMKVRPA--
GI|1312416    ESYANGINWSAAKGYKYSYKVSEMKVRPA--
GI|2135117    ESYANGINWSAAKGYKYSYKVSEMKVRPA--
GI|423207|    TSYANGVNWRSGRGYNYSYQVSEMKVRLT--
GI|1675844    KSYANGVNWKSWKGYNYSYKVSEMKVRLI--
```

The presence of identifiable domains in the protein disclosed herein was determined by searches using algorithms such as PROSITE, Blocks, Pfam, ProDomain, Prints and then determining the Interpro number by crossing the domain match (or numbers) using the Interpro website (http:www.ebi.ac.uk/interpro/). Table 25T lists the domain description from DOMAIN analysis results against NOV25.

TABLE 25T

Domain Analysis of NOV25

| Model | Region of Homology | Score (bits) | E value |
|---|---|---|---|
| Collagen triple helix repeat | 38–96 | 6.0 | 7.8e–05 |
| Fibrinogen beta and gamma chains, C-terminal globular domain | 96–308 | 325.6 | 3e–95 |

Consistent with other known members of the Fibrinogen family of proteins, e.g., ficolins, NOV25 contains fibrinogen and collagen domains as illustrated in Table 25T (Ohashi and Erickson, J. Biol. Chem., 272: 14220–6(1997)). NOV25 nucleic acids, and the encoded polypeptides, according to the invention are useful in a variety of applications and contexts. For example, NOV25 nucleic acids and polypeptides can be used to identify proteins that are members of the Fibrinogen family of proteins. The NOV25 nucleic acids and polypeptides can also be used to screen for molecules, which inhibit or enhance NOV25 activity or function. Specifically, the nucleic acids and polypeptides according to the invention may be used as targets for the identification of small molecules that modulate or inhibit, e.g., cellular activation, cellular metabolism, host defense and signal transduction. These molecules can be used to treat, e.g., arthritis, autoimmune disease, immunodeficiencies, anemia, ataxia-telangiectasia, hemophilia, hypercoagulation, idiopathic thrombocytopenic purpura, graft versus host disease, endometriosis, fertility, systemic lupus erythematosus, asthma, emphysema, scleroderma, allergies, ARDS, hypercoagulation, as well as other diseases, disorders and conditions.

In addition, various NOV25 nucleic acids and polypeptides according to the invention are useful, inter alia, as novel members of the protein families according to the presence of domains and sequence relatedness to previously described proteins. For example, the NOV25 nucleic acids and their encoded polypeptides include structural motifs that are characteristic of proteins belonging to the ficolin family of proteins involved in cytokine and steroid physiology (Ohashi and Erickson, J. Biol. Chem., 272: 14220–6(1997)).

Ficolin was originally isolated as a protein from pig uterus membrane extracts that bound transforming growth factor—(Ichijo et al., J. Biol. Chem., 266: 22459–64 91991)). Ficolins have also been identified from human blood as a corticosteroid binding protein, termed hucolin (Edgar, FEBS Lett., 375: 159–61 (1995)), an elastin binding protein, termed EBP-37 (Harumiya et al., J. Biochem., 117: 1029–35 (1995)), and a GlcNAc binding lectin, termed P35 (Matsushita et al., J. Biol. Chem. 271: 2448–54(1996)). Ficolin cDNAs, are termed human ficolin (Lu et al., Biochem. J., 313: 473–8(1996)), ficolin-1 (HarTumiya et al., J. Biochem., 120: 745–51(1996)), and P35-related gene (Endo et al., Genomics, 36: 515–21, (1996)) have been cloned.

The amino acid sequence of ficolins consist of a short N-terminal domain, a middle collagen-like domain, and aC-terminal fibrinogen-like (fbg)1domain (Ohashi and Erickson, J. Biol. Chem., 272: 14220–6(1997)). The collagen domains assemble these proteins into trimers, and electron microscopy shows that four or six trimers are connected together by the N-terminal domain, leaving the C-terminal lectin domains to project in a multimeric array (13–17). Like C1q and collectins play roles in immune defense, ficolins have been implicated in a similar role, in that human plasma ficolin (P35) is a lectin that binds to the carbohydrate of bacterial surface (Lu et al., Immunology, 89: 289–94(1996)) and enhances opsonic activity of white blood cells, e.g., polymorphonuclear neutrophils (Matsushita et al., J. Biol. Chem., 271: 2448–54(1996)). Ficolin may play a role in alleviating inflammation in joints and other sites of inflammation.

Indeed, experiments comparing the gene expression levels of matched white blood cell fraction, e.g., peripheral blood lymphocytes (PBLs), and synovial fluid from three Rheumatoid Arthritis (RA) patients showed significantly lower level of NOV25f of the present invention in the RA patients. Specifically, the NOV25f gene was found to be upregulated 26-fold The presence of this ficolin in the PBLs was, on average, 26-fold over the level found in the synoviocytes of these RA patients.

Based on the surprising result from GeneCalling that Ficolin is upregulated to such a high extent in PBLs vs synoviocytes in RA patients, and coupling this knowledge with the TaqMan profiles presented below, ficolin may be useful as a protein therapeutic in RA patients and other patients with autoimmune diseases. Ficolin, or pharmaceutically active portions thereof, may be administered to RA patients directly into the joint space of the knee or other joint space to alleviate inflammation and promote healing.

Protein therapeutics designed with the protein encoded for by NOV25 could function as an opsinin to target and eliminate bacteria by complement-mediated destruction. These proteins could be important for the treatment of bacterial septicemia. Ficolins may also have the ability to bind to elastins. Elastins are functionally important for lung alveolar development and inactivation of these proteins can lead to emphysema-like disease. Antibodies against NOV25 may prevent tissue destruction mediated by ficolin activity during emphysema, asthma and arthritis.

The NOV25 nucleic acids and polypeptides are useful for detecting specific cell types. For example, expression analysis has demonstrated that a NOV25 nucleic acid is expressed in white blood cells, Aorta, Colon, Bone Marrow, Joints, Peripheral Blood, Spleen, Pituitary Gland, Mammary gland/Breast, Uterus, Prostate, Lung, and Kidney.

Additional utilities for NOV25 nucleic acids and polypeptides according to the invention are disclosed herein.

NOV26

A NOV26 polypeptide has been identified as a ficolin-like protein (also referred to as 152736833). The disclosed novel NOV26 nucleic acid (SEQ ID NO:98) of 779 nucleotides is shown in Table 26A. The cDNA coding for the NOV26 was cloned by polymerase chain reaction (PCR) using the following primers: GCTCGCTGTCCTGCTAGTCTTGTT (SEQ ID NO:291) and AGAAACATAATTCTCCCTCTG-GTGAGG (SEQ ID NO:292) on the following pool of human cDNAs: Pool 1—Adrenal gland, bone marrow, brain—amygdala, brain cerebellum, brain—hippocampus, brain—substantia nigra, brain—thalamus, brain—whole, fetal brain, fetal kidney, fetal liver, fetal lung, heart, kidney, lymphoma—Raji, mammary gland, pancreas, pituitary gland, placenta, prostate, salivary gland, skeletal muscle, small intestine, spinal cord, spleen, stomach, testis, thyroid, trachea, uterus. The novel NOV26 nucleic acid sequences maps to the chromosome 9.

An ORF begins with an Kozak consensus ATG initiation codon at nucleotides 16–18 and ends with a TAG codon at nucleotides 625–627. A putative untranslated region and/or downstream from the termination codon is underlined in Table 26A, and the start and stop codons are in bold letters.

TABLE 26A

NOV26 Nucleotide Sequence (SEQ ID NO:98)

CTGAGTGGAGCCACCATGGCCCGGGGGCTCGCTGTCCTGCTAGTCTTGTTCCTGCATATCAAGAACC
TGCCTGCCCAGGCTGCGGACACATGTCCAGAGGTGAAGGTGGTGGGCCTGGAGGGCTCTGACAAGCT
CACCATTCTCCGAGGCTGCCCGGGGCTGCCCGGGGCCCCAGGGCCAAAGGGAGAGGCAGGTGTCATT
GGAGAGAGAGGAGAACGCGGTCTCCCTGGAGCCCCTGGAAAGGCAGGACCAGTGGGGCCCAAAGGAG
ACCGAGGAGAGAAGGGGATGCGTGGAGAGAAAGGAGACGCTGGGCAGTCTCAGTCGTGTGCGACAGG
CCCACGCAACTGCAAGGACCTGCTAGACCGGGGGTATTTCCTGAGCGGCTGGCACACCATCTACCTG
CCCGACTGCCGGCCCCTGACTGTGCTCTGTGACATGGACACGGACGGAGGGGGCTGGACCGTTTTCC
AGGGGAGCCTGGTGGTACGCCGACTGTCATGCTTCAAACCTCAATGGTCTCTACCTCATGGGACCCCA
TGAGAGCTATGCCAATGGTATCAACTGGAGTGCGGCGAAGGGGTACAAATATAGCTACAAGGTGTCA
GAGATGAAGGTGCGGCCCGCCTAGACGGGCCAGGACCCCTCCACATGCACCTGCTAGTGGGGAGGCC
ACACCCACAAGCGCTGCGTCGTGGAAGTCACCCCATTTCCCCAGCCAGACACACTCCCATGACGCCC
ACAGCTGCCCCTTTGCCCCCAGCTCAGTCAAGCCGCCACATG

The NOV26 protein (SEQ ID NO:99) encoded by SEQ ID NO:98 is 203 amino acid residues in length and is presented using the one-letter amino acid code in Table 26B. Psort analysis predicts the NOV26 protein of the invention to be localized extracellularly with a certainty of 0.4944. The Signal P predicts a likely cleavage site for a NOV26 peptide is between positions 22 and 23, i.e., at the dash in the sequence AQA-AD.

TABLE 26B

Encoded NOV26 protein sequence (SEQ ID NO:99)

MARGLAVLLVLFLHIKNLPAQAADTCPEVKVVGLEGSDKLTILRGCPGLPGAPGPKGEAGVIGER
GERGLPGAPGKAGPVGPKGDRGEKGMRGEKGDAGQSQSCATGPRNCKDLLDRGYFLSGWHTIYLP
DCRPLTVLCDMDTDGGGWTVFQGAWWYADCHASNLNGLYLMGPHESYANGINWSAAKGYKYSYKV
SEMKVRPA

A search against the Patp database, a proprietary database that contains sequences published in patents and patent publications, yielded several homologous proteins shown in Table 26C.

TABLE 26C

Patp results for NOV26

| Sequences producing High-scoring Segment Pairs: | Reading Frame | High Score | Smallest Sum Prob P(N) |
|---|---|---|---|
| >patp:AAR94183 Human 35 kDa opsonin protein P35 | +1 | 560 | 2.9e−78 |
| >patp:AAR30971 TGF-beta-1 binding protein | +1 | 582 | 7.7e−78 |
| >patp:AAR94179 Human 35 kDa opsonin P35 fragment (III) | +1 | 539 | 5.4e−75 |
| >patp:AAB19732 Human SECX Clone 4437909.0.4 | +1 | 200 | 9.7e−27 |
| >patp:AAB19733 Human SECX Clone 4437909.0.55 | +1 | 200 | 9.7e−27 |

In a BLAST search of public sequence databases, it was found, for example, that the nucleic acid sequence of this invention has 487 of 496 bases (98%) identical to a gb:GEN-BANK-ID:D83920|acc:D83920.1 mRNA from *Homo sapiens* (Human uterus mRNA for human ficolin-1, complete cds). The full amino acid sequence of the protein of the invention was found to have 152 of 152 amino acid residues (100%) identical to, and 152 of 152 amino acid residues (100%) similar to, the 319 amino acid residue ptnr:SP-TREMBL-ACC: Q92596 protein from *Homo sapiens* (FICOLIN).

NOV26 also has homology to the proteins shown in the BLASTP data in Table 26D.

TABLE 26D

BLAST results for NOV26

| Gene Index/ Identifier | Protein/Organism | Length (aa) | Identity (%) | Positives (%) | Expect |
|---|---|---|---|---|---|
| gi|8051584|ref|NP_0 01994.2| (NM_002003) | ficolin 1 precursor [*Homo sapiens*] | 326 | 136/152 (89%) | 136/152 (89%) | 1e-72 |
| gi|2135117|pir||JC4 942 | ficolin-1 precursor - human | 319 | 136/152 (89%) | 136/152 (89%) | 1e-72 |
| gi|13124165|sp|O0006 02| | FCN1_HUMAN FICOLIN 1 PRECURSOR (COLLAGEN/FIBRINO GEN DOMAIN-CONTAINING PROTEIN 1) (FICOLIN-A) (FICOLIN A) (M-FICOLIN) | 326 | 135/152 (88%) | 135/152 (88%) | 4e-72 |
| gi|1669354|dbj|BAA0 9707.1| (D63394) | P35-related protein [*Homo sapiens*] | 187 | 129/152 (84%) | 130/152 (84%) | 2e-64 |
| gi|423207|pir||B471 72 | ficolin-beta - pig | 326 | 109/152 (71%) | 118/152 (76%) | 1e-55 |

A multiple sequence alignment is given in Table 26E, with the NOV26 protein being shown on line 1 in Table 26E in a ClustalW analysis, and comparing the NOV26 protein with the related protein sequences shown in Table 26D. This BLASTP data is displayed graphically in the ClustalW in Table 26E.

Table 26E. ClustalW Analysis of NOV26

1) > NOV26; SEQ ID NO:99
2) > gi|8051584/ ficolin 1 precursor [*Homo sapiens*]; SEQ ID NO:293
3) > gi|2135117/ ficolin 1 precurson [*Homo sapiens*]; SEQ ID NO:294
4) > gi|1312416/ FCN1_Human Ficolin 1 precursor; SEQ ID NO:295
5) > gi|1669354/ P35-related protein [*Homo sapiens*] ; SEQ ID NO:296
6) > gi|423207|/ ficolin-beta [Pig]; SEQ ID NO:297

```
                        10         20         30         40         50
                ....|....|....|....|....|....|....|....|....|....|
NOV26           -------MARGLAVLLVLFLHIKNLPAQAADTCPEVKVVGLEGSDKLTIL
gi|8051584      MELSGATMARGLAVLLVLFLHIKNLPAQAADTCPEVKVVGLEGSDKLTIL
gi|2135117      -------MARGLAVLLVLFLHIKNLPAQAADTCPEVKVVGLEGSDKLTIL
gi|1312416      MELSGATMARGLAVLLVLFLHIKNLPAQAADTCPEVKVVGLEGSDKLTIL
gi|1669354      MELSGATMARGLAVLLVLFLHIKNLPAQAADTCPEVKVVGLEGSDKLTIL
gi|423207|      MELSRVAVALGPTGQLLLFLSFQTLAAQAADTCPEVKVVGLEGSDKLSIL 60         70         80         90        100
                ....|....|....|....|....|....|....|....|....|....|
NOV26           RGCPGLPGAPGPKGEAGVIGERGERGLPGAPGKAGPVGPKGDRGEKGMRG
gi|8051584      RGCPGLPGAPGPKGEAGVIGERGERGLPGAPGKAGPVGPKGDRGEKGMRG
gi|2135117      RGCPGLPGAPGPKGEAGVIGERGERGLPGAPGKAGPVGPKGDRGEKGMRG
gi|1312416      RGCPGLPGAPGPKGEAGVIGERGERGLPGAPGKAGPVGPKGDRGEKGMRG
```

```
            gi|1669354   RGCPGLPGAPGPKGEAGVIGERGERGLPGAPGKAGPVGP-----------
            gi|423207|   RGCPGLPGAAGPKGEAGANGPKGERGSPGVVGKAGPAGPKGDRGEKGARG 110        120        130        140        150
                           ....|....|....|....|....|....|....|....|....|....|
            NOV26        EKGDAGQSQSCATGPRNCKDLLDRGYFLSGWHTIYLPDCRPLTVLCDMDT
            gi|8051584   EKGDAGQSQSCATGPRNCKDLLDRGYFLSGWHTIYLPDCRPLTVLCDMDT
            gi|2135117   EKGDAGQSQSCATGPRNCKDLLDRGYFLSGWHTIYLPDCRPLTVLCDMDT
            gi|1312416   EKGDAGQSQSCATGPRNCKDLLDRGYFLSGWHNIYLPDCRPLTVLCDMDT
            gi|1669354   -KGDAGQSQSCATGPRNCKDLLDRGYFLSGWHTIYLPDCRPLTVLCDMDT
            gi|423207|   EKGEPGQLQSCATGPRTCKELLTRGHFLSGWHTIYLPDCQPLTVLCDMDT 160        170        180        190        200
                           ....|....|....|....|....|....|....|....|....|....|
            NOV26        DGGGWTVFQ----------------------------------------
            gi|8051584   DGGGWTVFQRRMDGSVDFYRDWAAYKQGFGSQLGEFWLGNDNIHALTAQG
            gi|2135117   DGGGWTVFQRRMDGSVDFYRDWAAYKQGFGSQLGEFWLGNDNIHALTAQG
            gi|1312416   DGGGWTVFQRRMDGSVDFYRDWAAYKQGFGSQLGEFWLGNDNIHALTAQG
            gi|1669354   DGGGWTVFQR---------------------------------------
            gi|423207|   DGGGWTVFQRRSDGSVDFYRDWAAYKRGFGSQLGEFWLGNDHIHALTAQG 210        220        230        240        250
                           ....|....|....|....|....|....|....|....|....|....|
            NOV26        -------------------------------------------------
            gi|8051584   SSELRVDLVDFEGNHQFAKYKSFKVADEAEKYKLVLGAFVGGSAGNSLTG
            gi|2135117   SSELRVDLVDFEGNHQFAKYKSFKVADEAEKYKLVLGAFVGGSAGNSLTG
            gi|1312416   SSELRVDLVDFEGNHQFAKYKSFKVADEAEKYKLVLGAFVGGSAGNSLTG
            gi|1669354   -------------------------------------------------
            gi|423207|   TSELRVDLVDFEGNHQFAKYRSFQVAGEAEKYKLVLGGFLEGNAGDSISS 260        270        280        290        300
                           ....|....|....|....|....|....|....|....|....|....|
            NOV26        ------------------------------GAWWYADCHASNLNG-LYLMGPHES
            gi|8051584   HNNNFFSTKDQDNDVSSSNCAEKFQGAWWYADCHASNLNG-LYLMGPHES
            gi|2135117   HNNNFFSTKDQDNDVSSSNCAEKFQGAWWYADCHASNLNG-LYLMGPHES
            gi|1312416   HNNNFFSTKDQDNDVSSSNCAEKFQGAWWYADCHASSLNG-LYLMGPHES
            gi|1669354   ------------------------------RMDGSVDFYRDWAA
            gi|423207|   HRDQFFSTKDQDNDNHSGNCAEQYHGAWWYNACHSSNLNG-RYLRGLHTS 310        320
                           ....|....|....|....|....|..
            NOV26        YANGINWSAAKGYKYSYKVSEMKVRPA
            gi|8051584   YANGINWSAAKGYKYSYKVSEMKVRPA
            gi|2135117   YANGINWSAAKGYKYSYKVSEMKVRPA
            gi|1312416   YANGINWSAAKGYKYSYKVSEMKVRPA
            gi|1669354   YKQGFGSQLGEFWLGNDNIHALTAQ--
            gi|423207|   YANGVNWRSGRGYNYSYQVSEMKVRLT
```

The presence of identifiable domains in the protein disclosed herein was determined by searches using algorithms such as PROSITE, Blocks, Pfam, ProDomain, Prints and then determining the Interpro number by crossing the domain match (or numbers) using the Interpro website (http:www.ebi.ac.uk/interpro/). Table 26F lists the domain description from DOMAIN analysis results against NOV26.

TABLE 26F

Domain Analysis of NOV26

| Model | Region of Homology | Score (bits) | E value |
|---|---|---|---|
| Collagen triple helix repeat (20 copies) | 43–101 | 44.1 | 1.6e−10 |
| Fibrinogen beta and gamma chains, C-terminal globular domain | 107–152 | 49.6 | 1.6e−14 |
| Fibrinogen beta and gamma chains, C-terminal globular domain | 153–203 | 50.8 | 7.5e−15 |

Consistent with other known members of the Fibrinogen family of proteins, e.g., ficolin, NOV26 contains fibrinogen and collagen domains as illustrated in Table 25T (Ohashi and Erickson, J. Biol. Chem., 272: 14220–6(1997)). NOV26 nucleic acids, and the encoded polypeptides, according to the invention are useful in a variety of applications and contexts. For example, NOV26 nucleic acids and polypeptides can be used to identify proteins that are members of the Fibrinogen family of proteins. The NOV26 nucleic acids and polypeptides can also be used to screen for molecules, which inhibit or enhance NOV26 activity or function. Specifically, the nucleic acids and polypeptides according to the invention may be used as targets for the identification of small molecules that modulate or inhibit, e.g., cellular activation, cellular metabolism, host defense and signal transduction. These molecules can be used to treat, e.g., arthritis, autoimmune disease, immunodeficiencies, anemia, ataxia-telangiectasia, hemophilia, emphysema, hypercoagulation, idiopathic thrombocytopenic purpura, graft versus host disease, endometriosis, fertility, systemic lupus erythematosus, asthma, emphysema, scleroderma, allergies, ARDS, hypercoagulation, as well as other diseases, disorders and conditions.

In addition, various NOV26 nucleic acids and polypeptides according to the invention are useful, inter alia, as novel members of the protein families according to the presence of domains and sequence relatedness to previously described proteins. For example, the NOV26 nucleic acids and their encoded polypeptides include structural motifs that are characteristic of proteins belonging to the ficolin family of proteins involved in cytokine and steroid physiology (Ohashi and Erickson, J. Biol. Chem., 272: 14220–6(1997)).

Ficolin was originally isolated as a protein from pig uterus membrane extracts that bound transforming growth factor—(Ichijo et al., J. Biol. Chem., 266: 22459–64 91991)). Ficolins have also been identified from human blood as a corticosteroid binding protein, termed hucolin (Edgar, FEBS Lett., 375: 159–61 (1995)), an elastin binding protein, termed EBP-37 (Harumiya et al., J. Biochem., 117: 1029–35 (1995)), and a GlcNAc binding lectin, termed P35 (Matsushita et al., J. Biol. Chem. 271: 2448–54(1996)). Ficolin cDNAs, are termed human ficolin (Lu et al., Biochem. J., 313: 473–8(1996)), ficolin-1 (Harumiya et al., J. Biochem., 120: 745–51(1996)), and P35-related gene (Endo et al., Genomics, 36: 515–21, (1996)) have been cloned.

The amino acid sequence of ficolins consist of a short N-terminal domain, a middle collagen-like domain, and a C-terminal fibrinogen-like (fbg)1domain (Ohashi and Erickson, J. Biol. Chem., 272: 14220–6(1997)). The collagen domains assemble these proteins into trimers, and electron microscopy shows that four or six trimers are connected together by the N-terminal domain, leaving the C-terminal lectin domains to project in a multimeric array (13–17). Like C1q and collectins play roles in immune defense, ficolins have been implicated in a similar role, in that human plasma ficolin (P35) is a lectin that binds to the carbohydrate of bacterial surface (Lu et al., Immunology, 89: 289–94(1996)) and enhances opsonic activity of white blood cells, e.g., polymorphonuclear neutrophils (Matsushita et al., J. Biol. Chem., 271: 2448–54(1996)). Ficolin may play a role in alleviating inflammation in joints and other sites of inflammation.

Protein therapeutics designed with the protein encoded for by NOV26 could function as an opsinin to target and eliminate bacteria by complement—mediated destruction. These proteins could be important for the treatment of bacterial septicemia. Ficolins may also have the ability to bind to elastins. Elastins are functionally important for lung alveolar development and inactivation of these proteins can lead to emphysema-like disease. Antibodies against NOV26 may prevent tissue destruction mediated by ficolin activity during emphysema, asthma and arthritis.

The NOV26 nucleic acids and polypeptides are useful for detecting specific cell types. For example, expression analysis has demonstrated that a NOV25 nucleic acid is expressed in peripheral blood leukocytes, uterus, spleen, lung, and thymus.

Additional utilities for NOV26 nucleic acids and polypeptides according to the invention are disclosed herein.

NOV27

A NOV27 polypeptide has been identified as a peroxisomal Ca-dependent solute carrier like protein (also referred to as CG56262-01). The disclosed novel NOV27 nucleic acid (SEQ ID NO:100) of 1551 nucleotides is shown in Table 27A. An ORF begins with a Kozak consensus ATG initiation codon at nucleotides 108–110 and ends with a TGA codon at nucleotides 1512–1514. A putative untranslated region and/or downstream from the termination codon is underlined in Table 27A, and the start and stop codons are in bold letters. The novel NOV27 nucleic acid sequences maps to the chromosome 19.

TABLE 27A

NOV27 Nucleotide Sequence (SEQ ID NO:100)

GCGGCCGCGGGAGCTGACCCTGCGGGGTCCCGGGGGGGGAGGGGGAGCCGCGAAGCCCCCACTGAGG
CCGCCGCTGCCGGGCCTCCCCTCCCCCCGGGCGGGCGCCATGCGGGGGAGCCCGGGCGACGCGGAG
CGGCGGCAGCGCTGGGGTCGCCTGTTCGAGGAGCTGGACAGTAACAAGGATGGCCGCGTGGACGTGC

TABLE 27A-continued

NOV27 Nucleotide Sequence (SEQ ID NO:100)

ACGAGTTGCGCCAGGGGCTGGCCAGGCTGGGCGGGGGCAACCCAGACCCCGGCGCCCAACAGGGTAT
CTCCTCTGAGGGTGATGCTGACCCAGATGGCGGGCTCGACCTGGAGGAATTTTCCCGCTATCTGCAG
GAGCGGGAACAGCGTCTGCTGCTCATGTTTCACAGTCTTGACCGGAACCAGGATGGTCACATTGATG
TCTCTGAGATCCAACAGAGTTTCCGAGCTCTGGGCATTTCCATCTCGCTGGAGCAGGCTGAGAAAAT
TTTGCACAGCATGGACCGAGACGGCACAATGACCATTGACTGGCAAGAATGGCGCGACCACTTCCTG
TTGCATTCGCTGGAAAATGTGGAGGACGTGCTGTATTTCTGGAAGCATTCCACGGTCCTGGACATTG
GCGAGTGCCTGACAGTGCCGGACGAGTTCTCAAAGCAAGAGAAGCTGACGGGCATGTGGTGGAAACA
GCTGGTGGCCGGCGCAGTGGCAGGTGCCGTGTCACGGACAGGCACGGCCCCTCTGGACCGCCTCAAG
GTCTTCATTCAGGTCCATGCCTCAAAGACCAACCGGCTGAACATCCTTGGGGGGCTTCGAAGCATGG
TCCTTGAGGGAGGCATCCGCTGCCTGTGGCGCGGCAATGGTATTAATGTACTCAAGATTGCCCCCGA
GTCAGCTATCAAGTTCATGGCCTATGAACAGGTGAGGAGGGCCATCCTGGGGCAGCAGGAGACACTG
CATGTGCAGGAGCGCTTCGTGGCTGGCTCCCTGGCTGGTGCCACAGCCCAAACCATCATTTACCCTA
TGGAGGTGCTGAAGACGCGGCTGACCTTGCGCCGGACGGGCCAGTATAAGGGGCTGCTGGACTGCGC
CAGGCGTATCCTGGAGAGGGAGGGGCCCCGTGCCTTCTACCGCGGCTACCTCCCCAACGTGCTGGGC
ATCATCCCCTATGCGGGCATCGACCTGGCCGTCTACGAGGTCCTGAAGAACTGGTGGCTTCAGCAGT
ACAGCCACGACTCGGCAGACCCAGGCATCCTCGTGCTCCTGGCCTGCGGTACCATATCCAGCACCTG
CGGCCAGATAGCCAGTTACCCGCTGGCCCTGGTCCGGACCCGCATGCAGGCACAAGCCTCCATCGAG
GGTGGCCCCCAGCTGTCCATGCTGGGTCTGCTACGTCACATCCTGTCCCAGGAGGGCATGCGGGGCC
TCTACCGGGGATCGCCCCCAACTTCATGAAGGTTATTCCAGCTGTGAGCATCTCCTATGTGGTCTA
CGAGAACATGAAGCAGGCCTTGGGGGTCACGTCCAGGTGAGGGACCCGGAGCCCGTCCCCCCAATCC
CTCACCCCCC

The NOV27 protein (SEQ ID NO:101) encoded by SEQ ID NO:100 is 468 amino acid residues in length and is presented using the one-letter amino acid code in Table 27B3 Psort analysis predicts the NOV27 protein of the invention to be localized in the cytoplasm with a certainty of 0.4500.

NOV27 has a SNP variant, whose variant position for its nucleotide and amino acid sequence is numbered according to SEQ ID NOS:100 and 101, respectively. A variant sequence can include a single nucleotide polymorphism (SNP). A SNP can, in some instances, be referred to as a "cSNP" to denote that the nucleotide sequence containing the SNP originates as a cDNA.

NOV27 has at least one variant. NOV27 variant 13376757 is a G to A SNP at 1529 bp of the nucleotide sequence that results in no change in the protein sequence since the SNP is not in the amino acid coding region.

TABLE 27B

Encoded NOV27 protein sequence (SEQ ID NO:101)

MRGSPGDAERRQRWGRLFEELDSNKDGRVDVHELRQGLARLGGGNPDPGAQQGISSEGDADPDGG
LDLEEFSRYLQEREQRLLLMFHSLDRNQDGHIDVSEIQQSFRALGISISLEQAEKILHSMDRDGT
MTIDWQEWRDHFLLHSLENVEDVLYFWKHSTVLDIGECLTVPDEFSKQEKLTGMWWKQLVAGAVA
GAVSRTGTAPLDRLKVFIQVHASKTNRLNILGGLRSMVLEGGIRCLWRGNGINVLKIAPESAIKF
MAYEQVRRAILGQQETLHVQERFVAGSLAGATAQTIIYPMEVLKTRLTLRRTGQYKGLLDCARRI
LEREGPRAFYRGYLPNVLGIIPYAGIDLAVYEVLKNWWLQQYSHDSADPGILVLLACGTISSTCG
QIASYPLALVRTRMQAQASIEGGPQLSMLGLLRHILSQEGMRGLYRGIAPNFMKVIPAVSISYVV
YENMKQALGVTSR

A search against the Patp database, a proprietary database that contains sequences published in patents and patent publications, yielded several homologous proteins shown in Table 27C.

TABLE 27C

Patp results for NOV27

| Sequences producing High-scoring Segment Pairs: | Reading Frame | High Score | Smallest Sum Prob P(N) |
|---|---|---|---|
| >patp:AAU27697 Human full-length polypeptide sequence #22 | +1 | 2403 | 2.8e−249 |
| >patp:AAU27869 Human contig polypeptide sequence #22 | +1 | 2403 | 2.8e−249 |
| >patp:AAM79077 Human protein | +1 | 1543 | 3.8e−158 |
| >patp:AAY66718 Membrane-bound protein PRO1106 | +1 | 1536 | 2.1e−157 |
| >patp:AAB65241 Human PRO1106 (UNQ549) | +1 | 1536 | 2.1e−157 |

In a BLAST search of public sequence databases, it was found, for example, that the nucleic acid sequence of this invention has 886 of 1379 bases (64%) identical to a gb:GENBANK-ID:AF123303|acc:AF123303.1 mRNA from Homo sapiens (calcium-binding transporter mRNA, partial cds). The full amino acid sequence of the protein of the invention was found to have 280 of 461 amino acid residues (60%) identical to, and 365 of 461 amino acid residues (79%) similar to, the 475 amino acid residue ptnr:SPTREMBL-ACC:O18757 protein from Oryctolagus cuniculus (PEROXISOMAL CA-DEPENDENT SOLUTE CARRIER).

NOV27 also has homology to the proteins shown in the BLASTP data in Table 27D.

TABLE 27D

BLAST results for NOV27

| Gene Index/ Identifier | Protein/Organism | Length (aa) | Identity (%) | Positives (%) | Expect |
|---|---|---|---|---|---|
| gi|13430868|ref|NP_ 077008.1| (NM_024103) | hypothetical protein MGC2615 [Homo sapiens] | 482 | 392/454 (86%) | 395/454 (86%) | 0.0 |
| gi|16549529|dbj|BAB 70825.1| (AK054901) | unnamed protein product [Homo sapiens] | 384 | 379/384 (98%) | 382/384 (98%) | 0.0 |
| gi|15620851|dbj|BAB 67789.1| (AB067483) | KIAA1896 protein [Homo sapiens] | 568 | 298/480 (62%) | 352/480 (73%) | 1e−168 |
| gi|11360341|pir| |T5 0686 | peroxisomal Ca-dependent solute carrier [imported] [Oryctolagus cuniculus] | 475 | 277/464 (59%) | 358/464 (76%) | 1e−165 |
| gi|18043565|gb|AAH1 9978.1|AAH19978 (BC019978) | Unknown (protein for MGC:28954) [Mus musculus] | 366 | 261/365 (71%) | 308/365 (83%) | 1e−156 |

A multiple sequence alignment is given in Table 27E, with the NOV27 protein being shown on line 1 in Table 27E in a ClustalW analysis, and comparing the NOV27 protein with the related protein sequences shown in Table 27D. This BLASTP data is displayed graphically in the ClustalW in Table 27E.

Table 27E. ClustalW Analysis of NOV27

1) > NOV27; SEQ ID NO:101
2) > gi|1343086/ hypothetical protein MGC2615 [*Homo sapiens*]; SEQ ID NO:298
3) > gi|1654952/ unnamed protein product [*Homo sapiens*] ; SEQ ID NO:299
4) > gi|1562085/ KIAA1896 protein [*Homo sapiens*] ; SEQ ID NO:300
5) > gi|1136034/ peroxisomal Ca-dependent solute carrier [*Oryctolagus cuniculus*] ; SEQ ID NO:301
6) > gi|1804356/ Unknown (protein for MGC:28954) [*Mus musculus*] ; SEQ ID NO:302

```
                            10        20        30        40        50
                   ....|....|....|....|....|....|....|....|....|....|
      NOV27        --------------------------------------------------
      gi|1343086   --------------------------------------------------
      gi|1654952   --------------------------------------------------
      gi|1562085   SELLLRPGTTAVLAHLKKQETAPACRASSLRTPGQSSQQLCSQRALVLWS
      gi|1136034   --------------------------------------------------
      gi|1804356   --------------------------------------------------

60        70        80        90       100
                   ....|....|....|....|....|....|....|....|....|....|
      NOV27        ----------------------------------MRGSPGDAERRQR---
      gi|1343086   ----------------------------------MRGSPGDAERRQR---
      gi|1654952   --------------------------------------------------
      gi|1562085   HPSKVNSRHRRRLEETVMLQMLWHFLASFFPRAGCHGSREGDDREVRGTP
      gi|1136034   -----------------------MLRWLRGFVLPTAACQGAEPPTR---
      gi|1804356   --------------------------------------------------
```

421                                    422

```
                110        120        130        140        150
              ....|....|....|....|....|....|....|....|....|....|
NOV27         ---WGRLFEELDSNKDGRVDVHELRQGLARLGGGNPDPGAQQGISSEGDA
gi|1343086    ---WGRLFEELDSNKDGRVDVHELRQGLARLGGGNPDPGAQQGISSEGDA
gi|1654952    --------------------------------------------------
gi|1562085    APAWRDQMASFLGKQDGRAEATEKRPTILLVVG--PAEQFPKKIVQAGDK
gi|1136034    ---YETLFQALDRNGVVDIRELQEGLKSLGIP-LGQDAEEKIFTTGDV
gi|1804356    --------------------------------------------------

160        170        180        190        200
              ....|....|....|....|....|....|....|....|....|....|
NOV27         DPDGGLDLEEFSRYLQEREQRLLLMFHSLDRNQDGHIDVSEIQQSFRALG
gi|1343086    DPDGGLDLEEFSRYLQEREQRLLLMFHSLDRNQDGHIDVSEIQQSFRALG
gi|1654952    -----------------------MFHSLDRNQDGHIDVSEIQQSFRALG
gi|1562085    DLDGQLDFEEFVHYLQDHEKKLRLVEKSLDKKNDGRIDAQEIMQSLRDLG
gi|1136034    NKDGKLDFEEFMKYLKDHEKKMKLAEKSLDKNNDGKIEASEIVQSLQTLG
gi|1804356    ------------------------------------------MQSLRDLG 210        220        230        240        250
              ....|....|....|....|....|....|....|....|....|....|
NOV27         ISISLEQAEKILHS----------MDRDGTMTIDWQEWRDHFLLHSLE
gi|1343086    ISISLEQAEKILHS----------MDRDGTMTIDWQEWRDHFLLHSLE
gi|1654952    ISISLEQAEKILHS----------MDRDGTMTIDWQEWRDHFLLHSLE
gi|1562085    VKISEQQAEKILKRIRTGHFWGPVTYMDKNGTMTIDWNEWRDYHLLHPVE
gi|1136034    LTISEQQAELILQS----------IDADGTMTVDWNEWRDYFLFNPVA
gi|1804356    VKISEQQAEKILK---S-------MDKNGTMTIDWNEWRDYHLLHPVE 260        270        280        290        300
              ....|....|....|....|....|....|....|....|....|....|
NOV27         NVEDVLYFWKHST-------------------------------------
gi|1343086    NVEDVLYFWKHSTLSSAGFSAWIKDSTAEQNRSKTTVLARRSGSHLKSQH
gi|1654952    NVEDVLYFWKHST-------------------------------------
gi|1562085    NIPEIILYWKHST-------------------------------------
gi|1136034    DIEEIIRFWKHSTG------------------------------------
gi|1804356    NIPEIILYWKHST-------------------------------------

310        320        330        340        350
              ....|....|....|....|....|....|....|....|....|....|
NOV27         ----------VLDIGECLTVPDEFSKQEKLTGMWWKQLVAGAVAGAVSRT
gi|1343086    FGRPKWADHEVLDIGECLTVPDEFSKQEKLTGMWWKQLVAGAVAGAVSRT
gi|1654952    ----------VLDIGECLTVPDEFSKQEKLTGMWWKQLVAGAVAGAVSRT
gi|1562085    ----------IFDVGENLTVPDEFTVEERQTGMWWRHLVAGGGAGAVSRT
gi|1136034    ----------IDIGDSLTIPDEFTEEERKSGQWWRQLLAGGIAGAVSRT
gi|1804356    ----------IFDVGENLTVPDEFTVEERQTGMWWRHLVAGGGAGAVSRT 360        370        380        390        400
              ....|....|....|....|....|....|....|....|....|....|
NOV27         GTAPLDRLKVFIQVHASKTNRLNILGGLRSMVLEGGIRCLWRGNINVLK
gi|1343086    GTAPLDRLKVMQVHASKTNRLNILGGLRSMVLEGGIRSLWRGNINVLK
gi|1654952    GTAPLDRLKVMQVHASKTNRLNILGGLRSMVLEGGIRSLWRGNINVLK
gi|1562085    CTAPLDRLKVLMQVHASRSNNMGIVGGFTQMIREGGARSLWRGNGINVLK
gi|1136034    STAPLDRLKVMMQVHGSKS--MNIFGGFRQMIKEGGVRSLWRGNGTNVIK
gi|1804356    CTAPLDRLKVLMQVHASRSNNMCIVGGFTQMIREGGAKSLWRGNGINVLK 410        420        430        440        450
              ....|....|....|....|....|....|....|....|....|....|
NOV27         IAPESAIKFMAYEQVRRAILGQQETLHVQERFVAGSLAGATAQTIIYPME
gi|1343086    IAPESAIKFMAYEQIKRAILGQQETLHVQERFVAGSLAGATAQTIIYPME
gi|1654952    IAPESAIKFMAYEQIKRAILGQQETLHVQERFVAGSLAGATAQTIIYPME
gi|1562085    IAPESAIKFMAYEQIKRLVGSDQETLRIHERLVAGSLAGATAQSSIYPME
gi|1136034    IAPETAVKFWVYEQYKKLTEEGQKIGTFERFISGSMAGATAQTFIYPME
gi|1804356    IAPESAIKFMAYEQMKRLVGSDQETLRIHERLVAGSLAGAIAQSSIYPME
```

```
                    460        470        480        490        500
                ....|....|....|....|....|....|....|....|....|....|
NOV27           VLKTRLTLRRTGQYKGLLDCARRILEREGPRAFYRGYLPNVLGIIPYAGI
gi|1343086      VLKTRLTLRRTGQYKGLLDCARRILEREGPRAFYRGYLPNVLGIIPYAGI
gi|1654952      VLKTRLTLRRTGQYKGLLDCARRILEREGPRAFYRGYLPNVLGIIPYAGI
gi|1562085      VLKTRMALRKTGQYSGMLDCARRILAREGVAAFYKGYVPNMLGIIPYAGI
gi|1136034      VMKTRLAVGKTGQYSGIYDCAKKILKYEGFGAFYKGYVPNLLGIIPYAGI
gi|1804356      VLKTRMALRKTGQYSGMLDCARRILAKEGVAAFYKGYIPNMLGIIPYAGI 510        520        530        540        550
                ....|....|....|....|....|....|....|....|....|....|
NOV27           DLAVYEVLKNWWLQQYSHDSADPGILVLLACGTISSTCGQIASYPLALVR
gi|1343086      DLAVYETLKNWWLQQYSHDSADPGILVLLACGTISSTCGQIASYPLALVR
gi|1654952      DLAVYETLKNWWLQQYSHDSADPGILVLLACGTISSTCGQIASYPLALVR
gi|1562085      DLAVYETLKNAWLQHYAVNSADPGVFVLLACGTMSSTCGQLASYPLALVR
gi|1136034      DLAVYELLKSHWLDNFAKDSVNPGVLVLLGCGALSSTCGQLASYPLALVR
gi|1804356      DLAVYETLKNTWLQRYAVNSADPGVFVLLACGTISSTCGQLASYPLALVR 560        570        580        590        600
                ....|....|....|....|....|....|....|....|....|....|
NOV27           TRMQAQASIEGGPQLSMLGLLRHILSQEGMRGLYRGIAPNFMKVIPAVSI
gi|1343086      TRMQAQG----------------------------WSTVARFQITATSAFQV
gi|1654952      TRMQAQASIEGGPQLSMLGLLRHILSQEGMRGLYRGIAPNFMKVIPAVSI
gi|1562085      TRMQAQASIEGAPEVTMSSLFKHILRTEGAFGLYRGLAPNFMKVIPAVSI
gi|1136034      TRMQAQAMLEGAPQLNMVGLFRRIISKEGLPGLYRGITPNFMKVLPAVGI
gi|1804356      TRMQAQASIEGAPEVTMSSLFKQILRTEGAFGLYRGLAPNFMKVIPAVSI

610
                ....|....|....|..
NOV27           SYVVYENMKQALGVTSR
gi|1343086      QAILLPQPPE-------
gi|1654952      SYVVYENMKQALGVTSR
gi|1562085      SYVVYENLKITLGVQSR
gi|1136034      SYVVYENMKQTLGVTQK
gi|1804356      SYVVYENLKITLGVQSR
```

The presence of identifiable domains in the protein disclosed herein was determined by searches using algorithms such as PROSITE, Blocks, Pfam, ProDomain, Prints and then determining the Interpro number by crossing the domain match (or numbers) using the Interpro website (http:www.ebi.ac.uk/interpro/). Table 27F lists the domain description from DOMAIN analysis results against NOV27.

TABLE 27F

Domain Analysis of NOV27

| Model | Region of Homology | Score (bits) | E value |
|---|---|---|---|
| EF hand | 13–41 | 28.0 | 1.1e−05 |
| EF hand | 81–109 | 22.4 | 0.00055 |
| Poly A polymerase regulatory subunit | 103–111 | 1.3 | 0.94 |
| EF hand | 117–145 | 12.6 | 0.072 |
| Mitochondrial carrier protein | 184–276 | 93.5 | 2.1e−25 |
| Mitochondrial carrier protein | 278–369 | 120.1 | 2.2e−33 |
| Mitochondrial carrier protein | 375–468 | 90.7 | 1.5e−24 |

Consistent with other known members of the mitochondrial carrier proteins, e.g., peroxisomal Ca-dependent solute carrier family of proteins, NOV27 contains EF hand calcium binding domains and mitochondrial carrier transport signature domains as illustrated in Table 27F. NOV27 nucleic acids, and the encoded polypeptides, according to the invention are useful in a variety of applications and contexts. For example, NOV27 nucleic acids and polypeptides can be used to identify proteins that are members of the peroxisomal Ca-dependent solute carrier family of proteins. The NOV27 nucleic acids and polypeptides can also be used to screen for molecules, which inhibit or enhance NOV27 activity or function. Specifically, the NOV27 nucleic acids and polypeptides according to the invention may be used as targets for the identification of small molecules that modulate or inhibit, e.g., transport facilitation. These molecules can be used to treat, e.g., cancer, trauma, regeneration (in vitro and in vivo), viral/bacterial/parasitic infections, atherosclerosis, aneurysm, hypertension, fibromuscular dysplasia, stroke, scleroderma, obesity, Von Hippel-Lindau (VHL) syndrome, Alzheimer's disease, stroke, tuberous sclerosis, hypercalceimia, Parkinson's disease, Huntington's disease, cerebral palsy, epilepsy, Lesch-Nyhan syndrome, multiple sclerosis, ataxia-telangiectasia, leukodystrophies, behavioral disorders, addiction, anxiety, pain, diabetes, autoimmune disease, renal artery stenosis, interstitial nephritis, glomerulonephritis, polycystic kidney disease, systemic lupus erythematosus, renal tubular acidosis, IgA nephropathy, hypercalceimia, muscular dystrophy, Lesch-Nyhan syndrome, myasthenia gravis and other diseases, disorders and conditions of the like.

In addition, various NOV27 nucleic acids and polypeptides according to the invention are useful, inter alia, as novel members of the protein families according to the presence of domains and sequence relatedness to previously described proteins. For example, the NOV27 nucleic acids and their encoded polypeptides include structural motifs and homology that are characteristic of proteins belonging to the family of mitochondrial carrier proteins such as the peroxisomal Ca-dependent solute carrier proteins.

Many calcium-binding proteins belong to the same evolutionary family and share a type of calcium-binding domain known as the EF-hand. This type of domain consists of a twelve residue loop flanked on both side by a twelve residue alpha-helical domain. Different types of substrate carrier proteins involved in energy transfer are found in the inner mitochondrial membrane such as the ADP, ATP carrier protein (AAC) (ADP/ATP translocase), the 2-oxoglutarate/malate carrier protein (OGCP), the phosphate carrier protein, which transports phosphate groups from the cytosol into the mitochondrial matrix all share a common carrier protein motif. NOV27 also resembles the peroxisomal Ca-dependent solute carrier from rabbit. Although the Psort suggests that this is a cytosolic protein rather than mitochondrial, it is hypothesized that it might function in the uncoupling of ATP translocation and play a role in metabolic disease.

The NOV27 nucleic acids and polypeptides, antibodies and related compounds according to the invention will be useful in therapeutic and diagnostic applications for the treatment of metabolic disorders. As such the NOV27 nucleic acids and polypeptides, antibodies and related compounds according to the invention may be used to treat metabolic disorders, e.g., cancer, trauma, regeneration (in vitro and in vivo), viral/bacterial/parasitic infections, atherosclerosis, aneurysm, hypertension, fibromuscular dysplasia, stroke, scleroderma, obesity, Von Hippel-Lindau (VHL) syndrome, Alzheimer's disease, stroke, tuberous sclerosis, hypercalceimia, Parkinson's disease, Huntington's disease, cerebral palsy, epilepsy, Lesch-Nyhan syndrome, multiple sclerosis, ataxia-telangiectasia, leukodystrophies, behavioral disorders, addiction, anxiety, pain, diabetes, autoimmune disease, renal artery stenosis, interstitial nephritis, glomerulonephritis, polycystic kidney disease, systemic lupus erythematosus, renal tubular acidosis, IgA nephropathy, hypercalceimia, muscular dystrophy, Lesch-Nyhan syndrome, and myasthenia gravis.

The NOV27 nucleic acids and polypeptides are useful for detecting specific cell types. For example, expression analysis has demonstrated that a NOV27 nucleic acid is expressed in Adrenal Gland/Suprarenal gland, Amygdala, Aorta, Brain, Bronchus, Cerebral Medulla/Cerebral white matter, Cervix, Coronary Artery, Frontal Lobe, Heart, Kidney, Liver, Lung, Mammary gland/Breast, Ovary, Oviduct/Uterine Tube/Fallopian tube, Parietal Lobe, Peripheral Blood, Pituitary Gland, Prostate, Retina, Skeletal Muscle, Spinal Chord, Spleen, Substantia Nigra, Temporal Lobe, Testis, Thalamus, Thymus, Thyroid, and Vein.

Additional utilities for NOV27 nucleic acids and polypeptides according to the invention are disclosed herein.

NOV28

A NOV28 polypeptide has been identified as a Sodium-glucose cotransporter (SGLT)-like protein (also referred to as CG56559-01). The disclosed novel NOV28 nucleic acid (SEQ ID NO:102) of 1900 nucleotides is shown in Table 28A. The novel NOV28 nucleic acid sequences maps to the chromosome 17.

An ORF begins with a Kozak consensus ATG initiation codon at nucleotides 51–53 and ends with a TGA codon at nucleotides 1851–1853. A putative untranslated region and/or downstream from the termination codon is underlined in Table 28A, and the start and stop codons are in bold letters.

TABLE 28A

NOV28 Nucleotide Sequence (SEQ ID NO:102)

TTGCCCCTCAGTCCCTCGGGCTCATACCTAGTGCCTGCGGCAGGACAGCCATGGCCGCCAACTCCAC
CAGCGACCTCCACACTCCCGGGACGCAGCTGAGCGTGGCTGACATCATCGTCATCACTGTGTATTTT
GCTCTGAACGTGGCCGTGGGCATATGGTCCTCTTGTCGGGCCAGTAGGAACACGGTGAATGGCTACT
TCCTGGCAGGCCGGGACATGACGTGGTGGCCGATTGGAGCCTCCCTCTTCGCCAGCAGCGAGGGCTC
TGGCCTCTTCATTGGACTGGCGGGCTCAGGCGCGGCAGGAGGTCTGGCCGTGGCAGGCTTCGAGTGG
AATGCCACGTACGTGCTGCTGGCACTGGCATGGGTGTTCGTGCCCATCTACATCTCCTCAGAGATCG
TCACCTTACCTGAGTACATTCAGAAGCGCTACGGGGGCCAGCGGATCCGCATGTACCTGTCTGTCCT
GTCCCTGCTACTGTCTGTCTTCACCAAGATATCGGCCCTGGACCTGTACGCGGGGGCTCTGTTTGTG
CACATCTGCCTGGGCTGGAACTTCTACCTCTCCACCATCCTCACGCTCGGCATCACAGCCCTGTACA
CCATCGCAGGTACTGGCGGCCTGGCTGCTGTAATCTACACGGACGCCCTGCAGACGCTCATCATGGT
GGTGGGGGCTGTCATCCTGACAATCAAAGCTTTTGACCAGATCGGTGGTTACGGGCAGCTGGAGGCA
GCCTACGCCCAGGCCATTCCCTCCAGGACCATTGCCAACACCACCTGCCACCTGCCACGTACAGACG
CCATGCACATGTTTCGAGACCCCCACACAGGGGACCTGCCGTGGACCGGGATGACCTTTGGCCTGAC
CATCATGGCCACCTGGTACTGGTGCACCGACCAGGTGATCGTGCAGCGATCACTGTCAGCCCGGGAC
CTGAACCATGCCAAGGCGGGCTCCATCCTGGCCAGCTACCTCAAGATGCTCCCCATGGGCCTGATCA
TCATGCCGGGCATGATCAGCCGCGCATTGTTCCCAGATGATGTGGGCTGCGTGGTGCCGTCCGAGTG
CCTGCGGGCCTGCGGGGCCGAGGTCGGCTGCTCCAACATCGCCTACCCCAAGCTGGTCATGGAACTG
ATGCCCATCGGTCTGCGGGGGCTGATGATCGCAGTGATGCTGGCGGCGCTCATGTCGTCGCTGACCT
CCATCTTCAACAGCAGCAGCACCCTCTTCACTATGGACATCTGGAGGCGGCTGCGTCCCCGCTCCGG
CGAGCGGGAGCTCCTGCTGGTGGGACGGTTGGTCATAGTGGCACTCATCGGCGTGAGTGTGGCCTGG
ATCCCCGTCCTGCAGGACTCCAACAGCGGGCAACTCTTCATCTACATGCAGTCAGTGACCAGCTCCC
TGGCCCCACCAGTGACTGCAGTCTTTGTCCTGGGCGTCTTCTGGCGACGTGCCAACGAGCAGCAGGG
GGCCTTCTGGGGCCTGATAGCAGGGCTGGTGGTGGGGGCCACGAGGCTGGTCCTGGAATTCCTGAAC
CCAGCCCCACCGTGCGGAGAGCCAGACACGCGGCCAGCCGTCCTGGGGAGCATCCACTACCTGCACT
TCGCTGTCGCCCTCTTTGCACTCAGTGGTGCTGTTGTGGTGGCTGGAAGCCTGCTGACCCCACCCCC
ACAGAGTGTCCAGATTGAGAACCTTACCTGGTGGACCCTGGCTCAGGATGTGCCCTTGGGAACTAAA
GCAGGTGATGGCCAAACACCCCAGAAACACGCCTTCTGGGCCCGTGTCTGTGGCTTCAATGCCATCC
TCCTCATGTGTGTCAACATATTCTTTTATGCCTACTTCGCCTGACACTGCCATCCTGGACAGAAAGG
CAGGAGCTCTGAGTCCTCAGGTCC

The NOV28 protein (SEQ ID NO:103) encoded by SEQ ID NO:102 is 600 amino acid residues in length and is presented using the one-letter amino acid code in Table 28B. NOV28 has at least five SNP variants, whose variant positions for its nucleotides and amino acids sequences is numbered according to SEQ ID NOS:102 and 103, respectively. A variant sequence can include a single nucleotide polymorphism (SNP). A SNP can, in some instances, be referred to as a "cSNP" to denote that the nucleotide sequence containing the SNP originates as a cDNA.

NOV28 variant 13376762 is an A to T SNP at 158 bp of the nucleotide sequence that results in no change in the protein sequence (silent), variant 13376761 is a C to T SNP at 491 bp of the nucleotide sequence that results in no change in the protein sequence (silent), variant 13376760 is a T to C SNP at 565 bp of the nucleotide sequence that results in a Leu to Pro change at amino acid 172 of protein sequence, variant 13376759 is a C to T SNP at 867 bp of the nucleotide sequence that results in no change in the protein sequence (silent), and variant 13376758 is a C to T SNP at 1762 bp of the nucleotide sequence that results in a Pro to Leu change at amino acid 571 of protein sequence.

Psort analysis predicts the NOV28 protein of the invention to be localized to the plasma membrane with a certainty of 0.8200. The Signal P predicts a likely cleavage site for a NOV28 peptide is between positions 42 and 43, i.e., at the dash in the sequence CRA-SR.

TABLE 28B

Encoded NOV28 protein sequence (SEQ ID NO:103)

MAANSTSDLHTPGTQLSVADIIVITVYFALNVAVGIWSSCRASRNTVNGYFLAGRDMTWWPIGASLFASSEGS
GLFIGLAGSGAAGGLAVAGFEWNATYVLLALAWVFVPIYISSEIVTLPEYIQKRYGGQRIRMYLSVLSLLLSV
FTKISALDLYAGALFVHICLGWNFYLSTILTLGITALYTIAGTGGLAAVIYTDALQTLIMVVGAVILTIKAFD
QIGGYGQLEAAYAQAIPSRTIANTTCHLPRTDAMHMFRDPHTGDLPWTGMTFGLTIMATWYWCTDQVIVQRSL
SARDLNHAKAGSILASYLKMLPMGLIIMPGMISRALFPDDVGCVVPSECLRACGAEVGCSNIAYPKLVMELMP
IGLRGLMIAVMLAALMSSLTSIFNSSSTLFTMDIWRRLRPRSGERELLLVGRLVIVALIGVSVAWIPVLQDSN
SGQLFIYMQSVTSSLAPPVTAVFVLGVFWRRANEQQGAFWGLIAGLVVGATRLVLEFLNPAPPCGEPDTRPAV
LGSIHYLHFAVALFALSGAVVVAGSLLTPPPQSVQIENLTWWTLAQDVPLGTKAGDGQTPQKHAFWARVCGFN
AILLMCVNIFFYAYFA

A search against the Patp database, a proprietary database that contains sequences published in patents and patent publications, yielded several homologous proteins shown in Table 28C.

TABLE 28C

Patp results for NOV28

| Sequences producing High-scoring Segment Pairs: | Reading Frame | High Score | Smallest Sum Prob P (N) |
|---|---|---|---|
| >patp:AAE06614 Human protein | +1 | 3051 | 6.1e−318 |
| >patp:AAE08088 Human transporter-related protein #35 | +1 | 3051 | 6.1e−318 |
| >patp:AAR73595 Cotransporter protein SGLT1 | +1 | 1669 | 5.2e−177 |
| >patp:AAR73593 Cotransporter protein SNST1 | +1 | 1655 | 4.2e−175 |

TABLE 28C-continued

Patp results for NOV28

| Sequences producing High-scoring Segment Pairs: | Reading Frame | High Score | Smallest Sum Prob P (N) |
|---|---|---|---|
| >patp:AAB60093 Human transport protein TPPT-13 | +1 | 1622 | 3.1e−168 |

In a BLAST search of public sequence databases, it was found, for example, that the nucleic acid sequence of this invention has 1451 of 1839 bases (78%) identical to a gb:GENBANK-ID:OCU08813|acc:U08813.1 mRNA from *Oryctolagus cuniculus* (Na+/glucose cotransporter-related protein mRNA, complete cds). NOV28 polypeptide of the invention was found to have 532 of 600 amino acid residues (88%) identical to, and 560 of 600 amino acid residues (93%) similar to, the 597 amino acid residue ptnr:SP-TREMBL-ACC:Q28610 protein from *Oryctolagus cuniculus* (NA+/GLUCOSE COTRANSPORTER-RELATED PROTEIN).

NOV28 also has homology to the proteins shown in the BLASTP data in Table 28D.

TABLE 28D

BLAST results for NOV28

| Gene Index/ Identifier | Protein/Organism | Length (aa) | Identity (%) | Positives (%) | Expect |
|---|---|---|---|---|---|
| gi|520469|gb|AAA66065.1| (U08813) | 597 aa protein related to Na/glucose cotransporters *Oryctolagus cuniculus*] | 597 | 486/600 (81%) | 513/600 (85%) | 0.0 |
| gi|16553933|dbj|BAB71619.1| (AK057946) | unnamed protein product [*Homo sapiens*] | 517 | 425/459 (92%) | 425/459 (92%) | 0.0 |
| gi|9588428|emb|CAC00574.1| (AL109659) | dJ1024N4.1 (novel Sodium:solute symporter family member similar to SLC5A1 (SGLT1)) [*Homo sapiens*] | 552 | 303/526 (57%) | 380/526 (71%) | 1e−159 |
| gi|631592|pir| |S48857 | glucose transport protein - sheep | 664 | 275/541 (50%) | 370/541 (67%) | 1e−152 |
| gi|1709219|sp|P53791| | SL51_SHEEP SODIUM/GLUCOSE COTRANSPORTER 1 (NA(+)/GLUCOSE COTRANSPORTER 1) (HIGH AFFINITY SODIUM-GLUCOSE COTRANSPORTER) | 664 | 275/541 (50%) | 371/541 (67%) | 1e−151 |

A multiple sequence alignment is given in Table 28E, with the NOV28 protein being shown on line 1 in Table 28E in a ClustalW analysis, and comparing the NOV28 protein with the related protein sequences shown in Table 28D. This BLASTP data is displayed graphically in the ClustalW in Table 28E.

Table 28E. ClustalW Analysis of NOV28

1) > NOV28; SEQ ID NO:103
2) > gi|520469|/ 597 aa protein related to Na/glucose cotransporters [*Oryctolagus cuniculus*]; SEQ ID NO:303
3) > gi|1655393/unnamed protein product [*Homo sapiens*]; SEQ ID NO:304
4) > gi|9588428/ dJ1024N4.1 (novel Sodium:solute symporter family member similar to SLC5A1 (SGLT1) [*Homo sapiens*]; SEQ ID NO:305
5) > gi|631592|/ glucose transport protein [sheep]; SEQ ID NO:306
6) > gi|1709219/ SL51_sheep sodium/glucose cotransporter 1 Na+/glucose cotransporter 1) (high affinity sodium-glucose cotransporter); SEQ ID NO:307

```
                           10        20        30        40        50
                  ....|....|....|....|....|....|....|....|....|....|
NOV28            --------MAANSTSDLHTPGTQLS--VADIIVITVYFALNVAVGIWSSC
gi|520469|       -------MVADNSTSDPHAPGPQLS--VTDIVVITVYFALNVAVGIWSSC
gi|1655393       --------MPRICCWHWH-------------------------G--CSC
gi|9588428       MGPGASGDGVRIETAPHIALDSRVGLHAYDISVVVIYFVFVIAVGIWSSI
gi|631592|       MDS-STLSPPAIDIAEPLQAYERIR-NAADISVIVIYFVVVMAVGLWHMF
gi|1709219       MDS-STWSPPAIAIAEPLQAYERIR-NAADISVIVIYFVVVMAVGLWAMF 60        70        80        90       100
                  ....|....|....|....|....|....|....|....|....|....|
NOV28            RASRNTVNGYFLAGRDMWWPIGASLFASSEGSGLFIGLAGSGAAGGLAV
gi|520469|       RASRNTVSGYFLAGRDMWWPIGASLFGSSEGSGLFIGLAGSGAAGGLAV
gi|1655393       PS---TS-------------PQRSSPYLSTFRS--ATGASGS-ACTCLSC
gi|9588428       RASRGTIGGYFLAGRSMWWPIGASLMSSNVGSGLFIGLAGTGAAGGLAV
gi|631592|       STNRGTVGGFFLAGRSMVWWPIGASLFASNIGSGHFVGLAGTGAAAGIAT
gi|1709219       STNRGTVGGFFLAGRSMVWWPIGASLFASNIGSGHFVGLAGTGAAAGIAT 110       120       130       140       150
                  ....|....|....|....|....|....|....|....|....|....|
NOV28            AGFEWNATYVLLALAWVFVPIYISSEIVTLPEYIQKRYGGQRIRMYLSVL
gi|520469|       AGFDWNATYVLLALAWVFGAIYISSEIVTLAEYIQKRFGGQRIRMYLSVL
gi|1655393       P--------------CYCLS--S------PRYR----------------
gi|9588428       GGFEWNATWLLLALGWVFVPVYIAAGVVIMPQYLKKRFGGQRIQVYMSVL
gi|631592|       GGFEWNALILVVLLGWVFVPIYIKAGVVIMPEYLRKRFGGQRIQVYLSVL
gi|1709219       GGFEWNALILVVLLGWVFVPIYIKAGVVIMPEYLRKRFGGQRIQVYLSVL 160       170       180       190       200
                  ....|....|....|....|....|....|....|....|....|....|
NOV28            SILISVFTKISALDLYAGALFVHICLGWNFYLSTILTLGITALYTIAGTG
gi|520469|       SLLISVFTKIS-LDLYAGALFVHICLGWNFYLSTILTLTITALYTITC--
gi|1655393       ----WTCIR-------GALFVHICLGWNFYLSTILTIGITALYTIAC--
gi|9588428       SLIIYIFTKIS-TDIFSGALFIQMALGWNLYLSTGILLVVTAVYTIIAC--
gi|631592|       SIVLYIFTKIS-ADIFSGAIINLALGLDLYLAIFILLAITALYTITC--
gi|1709219       SIVLYIFTKIS-ADIFSGAIINLALGLDLYLAIFILLAITALYTITC--

210       220       230       240       250
                  ....|....|....|....|....|....|....|....|....|....|
NOV28            GLAAVIYTDALQTLIMVVGAVILTIKAFDQIGGYGQLEAAYAQAIPSRTI
gi|520469|       GLVAVIYTDALQTLLMVVGAVILAIKAFHQIDGYGQMEAAYARAIPSRTV
gi|1655393       GLAAVIYTDALQTLIMVVGAVILTIKAFDQIGGYGQLEAAYAQAIPSRTI
gi|9588428       GLMAVIYTDALQTVIMVGGALVLMFLGFQDVGWYPGLEQRYRQAIPNVIV
gi|631592|       GLAAVIYTDTLQTVIMLLGSFILTGFAFHEVGGYSAFVTKYMNAIPTVIS
```

```
gi|1709219   GLAAVIYTDTLQTVIMLLGSFILTGFAHEVGGYSAFVTKYMNAIPTVTS 260       270       280       290       300
                ....|....|....|....|....|....|....|....|....|....|
NOV28        ANTT-----CHLPRTDAMHMFRDPHTGDLPWTGMTFGLTIMATWYWCTDQ
gi|520469|   ANTT-----CHLPRADAMHMFRDPYTGDLPWTGMTFGLTIMATWYWCTDQ
gi|1655393   ANTT-----CHLPRTDAMHMFRDPHTGDLPWTGMTFGLTIMATWYWCTDQ
gi|9588428   PNTT-----CHLPRPDAFHILRDPVSGDIPWPGLIFGLTVLATWCWCTDQ
gi|631592|   YGNTTVKKECYTPRADSFHIFRDPLKGDLPWPGLIFGLTIISLWYWCTDQ
gi|1709219   YGNTTVKKECYTPRADSFHIFRDPLKGDLPWPGLIFGLTIISLWYWCTDQ 310       320       330       340       350
                ....|....|....|....|....|....|....|....|....|....|
NOV28        VIVQRSLSARDLNHAKAGSILASYLKMLPMGLIIMPGMISRALFP-----
gi|520469|   VIVQRSLSARNLNHAKAGSILASYLKMLPMGLMIMPGMISRALFP-----
gi|1655393   VIVQRSLSARDLNHAKAGSILASYLKMLPMGLIIMPGMISRALFPGAHVY
gi|9588428   VIVQRSLSAKSLSHAKGGSVLGGYLKILPMFFIVMPGMISRALFP-----
gi|631592|   VIVQRCLSAKNMSHVKAGCIMCGYMKLLPMFLMVMPGMISRILFT-----
gi|1709219   VIVQRCLSAKNMSHVKAGCIMCGYMKLLPMFLMVMPGMISRILFT-----

360       370       380       390       400
                ....|....|....|....|....|....|....|....|....|....|
NOV28        ----------DDVGCVVPSECLRACGAEVGCSNIAYPKLVMELMPIGLR
gi|520469|   ----------DEVGCVVPSECLRACGAEIGCSNIAYPKLVMELMPVGLR
gi|1655393   EERHQVSVSRTDDVGCVVPSECLRACGAEVGCSNIAYPKLVMELMPIGLR
gi|9588428   ----------DEVGCVDPDVCQRICGARVGCSNIAYPKLVMALMPVGLR
gi|631592|   ----------EKVACTVPSECEKYCGTKVGCTNIAYPTLVVELMPNGLR
gi|1709219   ----------EKVACTVPSECEKYCGTKVGCTNIAYPTLVVELMPNGLR 410       420       430       440       450
                ....|....|....|....|....|....|....|....|....|....|
NOV28        GLMIAVMLAALMSSLTSIFNSSSTLFTMDIWRRLRPSGERELLLVGRIV
gi|520469|   GLMIAVMMPALMSSLSSIFNSSSTLFTMDIWRRLRPCASERELLLVGRLV
gi|1655393   GLMIAVMLAALMSSLTSIFNSSSTLFTMDIWRRLRPSGERELLLVGRIV
gi|9588428   GLMIAVIMAALMSSLTSIFNSSSTLFTIDVWQRFRRKSTEQELMVVGRVF
gi|631592|   GLMLSVMLASLMSSLTSIFNSASTLFTMDIYTKIRKKASEKELMIAGRLF
gi|1709219   GLMLSVMLASLMSSLTSIFNSASTLFTMDIYTKIRKKASEKELMIAGRLF 460       470       480       490       500
                ....|....|....|....|....|....|....|....|....|....|
NOV28        IVALIGVSVAWIPVLQDSNSGQLFIYMQSVTSSLAPPVTAVFVLGVFWRR
gi|520469|   IVVLIGVSVAWIPVLQGSNGGQLFIYMQSVTSSLAPPVTAVFTLGIFWQR
gi|1655393   IVALIGVSVAWIPVLQDSNSGQLFIYMQSVTSSLAPPVTAVFVLGVFWRR
gi|9588428   VVFLVVISILWIPIIQSSNSGQLFDYIQAVTSYLAPPITALFLLAIFCKR
gi|631592|   MLVLIGVSIAWVPIVQSAQSGQLFDYIQSITSYLGPPIAAVFLLAIFCKR
gi|1709219   MLVLIGVSIAWVPIVQSAQSGQLFDYIQSITSYLGPPIAAVFLLAIFCKR 510       520       530       540       550
                ....|....|....|....|....|....|....|....|....|....|
NOV28        ANEQQGAFWGLIAGLVVGATRLVLEFLNPAPPCGEPDTRPAVLGSIHYLH
gi|520469|   ANEQ-GAFWGLIAGLAVGATRLVLEFLHPAPPCGAADTRPAVLSQLHYLH
gi|1655393   ANEQ-GAFWGLIAGLVVGATRLVLEFLNPAPPCGEPDTRPAVLGSIHYLH
gi|9588428   VTEP-GAFWGLVFGLGVGLLRMILEFSYPAPACGEVDRRPAVLKDFHYLY
gi|631592|   VNEP-GAFWGLIIGFLIVSRMITEFAYGTGSCMEPSNCPTIICGVHYIY
gi|1709219   VNEP-GAFWGLIIGFLIVSRMITEFAYGTGSCMEPSNCPTIICGVHYIY 560       570       580       590       600
                ....|....|....|....|....|....|....|....|....|....|
NOV28        FAVALEALSGAVVVAGSLLTPPPQSVQIENLTWT---LAQDVPLGTKAG
gi|520469|   FAVALEVLTGAVVVGGSLLTPPPRRHQIENLTWT---LTRDLSIGAKAG
gi|1655393   FAVALEALSGAVVVAGSLLTPPPQSVQIENLTWT---LAQDVPLGTKAG
gi|9588428   FAILLCGLTAIVIVIVSLCTTPIPEEQ----------------------
gi|631592|   FAIILFVITIIVIKPIADVHLYRLCWSLRNSKEERIDLDAEDE
```

```
gi|1709219    FAIILFVITIIVILAISLFIKPIADVHLYRLCWSLRNSKEERIDLDAEDE 610       620       630       640       650
                       ....|....|....|....|....|....|....|....|....|....|
NOV28         DGQTP---------------------------------------------
gi|520469|    DGQTP---------------------------------------------
gi|1655393    DGQTP---------------------------------------------
gi|9588428    --------------------------------------------------
gi|631592|    DIQDAREDALEIDTEASEEKKGCLRQAYDMFCGLDQQKGPKMTKEEEAAM
gi|1709219    DIQDAREDALEIDTEASEEKKGCLRQAYDMFCGLDQQKGPKMTKEEEAAM 660       670       680
                       ....|....|....|....|....|....|....|.
NOV28         -------QKHAFWARVCGFNAILLMCVNIFFYAYFA
gi|520469|    -------QRYTFWARVCGFNAILLMCVNIFFYAYFA
gi|1655393    -------QKHAFWARVCGFNAILLMCVNIFFYAYFA
gi|9588428    ------------------------------------
gi|631592|    KLKMTDTSEKRLWRMVVNINGIILLAVAVFCHAYFA
gi|1709219    KLKMTDTSEKRLWRMVVNINGIILLAVAVFCHAYFA
```

The presence of identifiable domains in the protein disclosed herein was determined by searches using algorithms such as PROSITE, Blocks, Pfam, ProDomain, Prints and then determining the Interpro number by crossing the domain match (or numbers) using the Interpro website (http:www.ebi.ac.uk/interpro/). Table 28F lists the domain description from DOMAIN analysis results against NOV28.

TABLE 28F

Domain Analysis of NOV28

| Model | Region of Homology | Score (bits) | E value |
|---|---|---|---|
| Sodium:solute symporter family | 50–483 | 632.5 | 1.3e−187 |
| Amino acid permease | 62–469 | −349.6 | 0.47 |
| Virulence factor MVIN | 79–533 | −256.4 | 0.6 |
| Permease family | 97–431 | −191.3 | 0.54 |
| Uncharacterised protein family (Hly-III/ UPF0073) | 269–532 | −135.5 | 0.2 |
| Scorpion short toxin | 335–345 | 632.5 | 1.3e−187 |

Consistent with other known members of the sodium:solute symporter family (SSF), the NOV28 Na+/glucose transporter-like protein contains the sodium:solute symporter family domain and an integral membrane domain as illustrated in Table 28F (Ohashi and Erickson, J. Biol. Chem., 272: 14220–6(1997)). NOV28 nucleic acids, and the encoded polypeptides, according to the invention are useful in a variety of applications and contexts. For example, NOV28 nucleic acids and polypeptides can be used to identify proteins that are members of the sodium:solute symporter family of proteins. The NOV28 nucleic acids and polypeptides can also be used to screen for molecules, which inhibit or enhance NOV28 activity or function. Specifically, the nucleic acids and polypeptides according to the invention may be used as targets for the identification of small molecules that modulate or inhibit, e.g., cellular activation and cellular metabolism. These molecules can be used to treat, e.g., for metabolic diseases such cancer, trauma, regeneration (in vitro and in vivo), viral/bacterial/parasitic infections, diabetes, autoimmune disease, renal artery stenosis, interstitial nephritis, glomerulonephritis, polycystic kidney disease, systemic lupus erythematosus, renal tubular acidosis, IgA nephropathy, hypercalceimia, Lesch-Nyhan syndrome, cardiomyopathy, atherosclerosis, hypertension, congenital heart defects, aortic stenosis, atrial septal defect (ASD), atrioventricular (A-V) canal defect, ductus arteriosus, pulmonary stenosis, subaortic stenosis, ventricular septal defect (VSD), valve diseases, tuberous sclerosis, scleroderma, obesity, transplantation and other diseases, disorders and conditions of the like.

In addition, various NOV28 nucleic acids and polypeptides according to the invention are useful, inter alia, as novel members of the protein families according to the presence of domains and sequence relatedness to previously described proteins. For example, the NOV28 nucleic acids and their encoded polypeptides include structural motifs that are characteristic of proteins belonging to the SSF family such as the Na+/glucose transporter proteins involved in renal transport and metabolism. (Ohashi and Erickson, J. Biol. Chem., 272: 14220–6(1997)).

Integral membrane proteins that mediate the intake of a wide variety of molecules with the concomitant uptake of sodium ions are grouped into a number of distinct families. One of these families, known as the SSF, consists of integral membrane proteins that are predicted to comprise at least ten membrane spanning domains. Members of the SSF catalyze solute:Na+ symport (Reizer et al.,. Biochem. Biophys. Acta, 1197: 133–166(1994)) can transport sugars, amino acids, nucleosides, inositols, vitamins, urea or anions, depending on the system. Members of the SSF family have been identified in bacteria, archaea and animals, and all functionally well characterized members catalyze solute uptake via Na+ symport.

The NOV28 nucleic acids and polypeptides, antibodies and related compounds according to the invention will be useful in therapeutic and diagnostic applications in the mediation of metabolism and immune function and renal physiology. As such, the NOV28 nucleic acids and polypeptides, antibodies and related compounds according to the invention may be used to treat metabolic, immune and renal disorders, e.g., metabolic diseases such as diabetes and hypertension, or cancer, trauma, regeneration (in vitro and in vivo), viral/bacterial/parasitic infections, diabetes, autoimmune disease, renal artery stenosis, interstitial nephritis, glomerulonephritis, polycystic kidney disease, systemic lupus erythematosus, renal tubular acidosis, IgA nephropathy, hypercalceimia, Lesch-Nyhan syndrome, cardiomyopathy, atherosclerosis, hypertension, congenital heart defects, aortic stenosis, atrial septal defect (ASD), atrioventricular (A-V) canal defect, ductus arteriosus, pulmonary stenosis, subaortic stenosis, ventricular septal defect (VSD), valve diseases, tuberous sclerosis, scleroderma, obesity, transplantation and other diseases, disorders and conditions of the like. The NOV28 nucleic acids and polypeptides are useful for detecting specific cell types. For example, expression analysis has demonstrated that a NOV28 nucleic acid is expressed in Kidney and Heart.

Additional utilities for NOV28 nucleic acids and polypeptides according to the invention are disclosed herein.

NOV29

A NOV29 polypeptide has been identified as a Na+/glucose transporter-like protein. Six alternative novel NOV29, NOV29a, NOV29b, NOV29c, NOV29d, NOV29e, and NOV29f, nucleic acids and encoded polypeptides are provided. The novel NOV29 nucleic acid sequences maps to the chromosome 1.

NOV29a

A NOV29 variant is the novel NOV29a (alternatively referred to herein as CG56557-01), which includes the 2147 nucleotide sequence (SEQ ID NO:104) shown in Table 29A. A NOV29a ORF begins with a Kozak consensus ATG initiation codon at nucleotides 6–68 and ends with a TGA codon at nucleotides 2118–2120. Putative untranslated regions upstream from the initiation codon and downstream from the termination codon are underlined in Table 29A, and the start and stop codons are in bold letters.

TABLE 29A

NOV29a Nucleotide Sequence (SEQ ID NO:104)

TTAAAGGAAAGGAATGAAGCCAGGAGCGCCTCAAAGTCCAGCCTGCTGTTGACCAACACTAACAGAT
GAGCAAGGAGCTGGCAGCAATGGGGCCTGGAGCTTCAGGGGACGGGGTCAGGACTGAGACAGCTCCA
CACATAGCACTGGACTCCAGAGTTGGTCTGCACGCCTACGACATCAGCGTGGTGGTCATCTACTTTG
TCTTCGTCATTGCTGTGGGGATCTGGTCGTCCATCCGTGCAAGTCGAGGGACCATTGGCGGCTATTT
CCTGGCCGGGAGGTCCATGAGCTGGTGGCCAGTGGGAGCATCTCTGATGTCCAGCAATGTGGGCAGT
GGCTTGTTCATCGGCCTGGCTGGGACAGGGGCTGCCGGAGGCCTTGCCGTAGGTGGCTTCGAGTGGA
ACGTAAGGAAGCTGGCCTGGTTTCTCGTCTTCGTCCCTGTGTACATCGCAGCAGGTGTGGTCACAAT
GCCGCAGTATCTGAAGAAGCGATTTGGGGGCCAGAGGATCCAGGTGTACATGTCTGTCCTGTCTCTC
ATCCTCTACATCTTCACCAAGATCTCGGTAGACATCTTCTCTGGAGCCCTCTTCATCCAGATGGCAT
TGGGCTGGAACCTGTACCTCTCCACAGGGATCCTGCTGGTGGTGACTGCCGTCTACACCATTGCAGG
TGGCCTCATGGCCGTGATCTACACAGATGCTCTGCAGACGGTGATCATGGTAGGGGGAGCCCTGGTC
CTCATGTTTCAGGACGTGGGCTGGTACCCAGGCCTGGAGCAGCGGTACAGGCAGGCCATCCCTAATG
TCACAGTCCCCAACACCACCTGTCACCTCCCACGGCCCGATGCTTTCCACATTCTTCGGGACCCTGT
GAGCGGGGACATCCCTTGGCCAGGTCTCATTTTCGGGCTCACAGTGCTGGCCACCTGGTGTTGGTGC
ACAGACCAGGTCATTGTGCAGCGGTCTCTCTCGGCCAAGAGTCTGTCTCATGCCAAGGGAGGCTCCG
TGCTGGGGGGCTACCTGAAGATCCTCCCCATGTTCTTCATCGTCATGCCTGGCATGATCAGCCGGGC
CCTGTTCCCAGACGAGGTGGGCTGCGTGGACCCTGATGTCTGCCAAAGAATCTGTGGGGCCCGAGTG
GGATGTTCCAACATTGCCTACCCTAAGTTGGTCATGGCCCTCATGCCTGTTGGTCGGGGGCTGATGA
TTGCCGTGATCATGGCCGCTCTCATGAGCTCACTCACCTCCATCTTCAACAGCAGCAGCACCCTGTT
CACCATTGATGTGTGGCAGCGCTTCCGCAGGAAGTCAACAGAGCAGGAGCTGATGGTGGTGGGCAGG
GTGTTTGTGGTGTTCCTGGTTGTCATCAGCATCCTCTGGATCCCCATCATCCAAAGCTCCAACAGTG
GGCAGCTCTTCGACTACATCCAGGCTGTCACCAGTTACCTGGCCCCACCCATCACCGCTCTCTTCCT
GCTGGCCATCTTCTGCAAGAGGGTCACAGAGCAGGGAGCTTTCTGGGGCCTCGTGTTTGGCCTGGGA
GTGGGGCTTCTGCGTATGATCCTGGAGTTCTCATACCCAGCGCCAGCCTGTGGGGAGGTGGACCGGA
GGCCAGCAGTGCTGAAGGACTTCCACTACCTGTACTTTGCAATCCTCCTCTGCGGGCTCACTGCCAT
CGTCATTGTCATTGTCAGCCTCTGTACAACTCCCATCCCTGAGGAACAGGCAAGTCGCCTCACATGG
TGGACTCGGAACTGCCCCCTCTCTGAGCTGGAGAAGGAGGCCCCCCCATACTTTCCATCAGTATCTC
ACCATCTCTCTCCCTCCCCTACTCTCCTATCACTTTCCTTTCTCCAATCTTCTTTGCCTCTCCCCTC
CTGCTCTCCTTTGTCTTCTGGCTTTGTCCCTCCAGCCCCAAGCAGGTCCTGGGGAAAGTTGCTCTGG
AGCTGGTTCTGTGGGCTCTCTGGAACACCGGAGCAGGCCCTGAGCCCAGCAGAGAAGGCTGCGCTAG
AACAGAAGCTGACAAGCATTGAGGAGGAGCCACTCTGGAGACATGTCTGCAACATCAATGCTGTCCT
TTTGCTGGCCATCAACATCTTCCTCTGGGGCTATTTTGCGTGATTCCACAGACCTGGCTTCAGTGTA
GAC

The NOV29a polypeptide (SEQ ID NO:105) encoded by SEQ ID NO:104 is 684 amino acid residues in length and is presented using the one-letter amino acid code in Table 29B. NOV29a has two SNP variants, whose variant positions for their nucleotide and amino acid sequences is numbered according to SEQ ID NOS:104 and 105, respectively. A variant sequence can include a single nucleotide polymorphism (SNP). A SNP can, in some instances, be referred to as a "cSNP" to denote that the nucleotide sequence containing the SNP originates as a cDNA. NOV29a Variant 13374708 is a G to A SNP at 774 bp of the nucleotide sequence that results in no change in the protein sequence (silent). NOV29a variant 13375611 is a T to C SNP at 1572 bp of the nucleotide sequence that results in a Ser to Pro change at amino acid 503 of protein sequence, and NOV29a variant 13375610 is a T to C SNP at 1684 bp of the nucleotide sequence that results in a Val to Ala change at amino acid 540 of protein sequence.

The Psort profile for the NOV29a predicts that this peptide is likely to be localized at the plasma membrane with a certainty of 0.8000. The Signal P predicts a likely cleavage site for a NOV29a peptide is between positions 59 and 60, i.e., at the dash in the sequence IRA-SR.

TABLE 29B

NOV29a protein sequence (SEQ ID NO:105)

MSKELAAMGPGASGDGVRTETAPHIALDSRVGLHAYDISVVVIYFVFVIAVGIWSSIRASRGTIGGY
FLAGRSMSWWPVGASLMSSNVGSGLFIGLAGTGAAGGLAVGGFEWNVRKLAWFLVFVPVYIAAGVVT
MPQYLKKRFGGQRIQVYMSVLSLILYIFTKISVDIFSGALFIQMALGWNLYLSTGILLVVTAVYTIA
GGLMAVIYTDALQTVIMVGGALVLMFQDVGWYPGLEQRYRQAIPNVTVPNTTCHLPRPDAFHILRDP
VSGDIPWPGLIFGLTVLATWCWCTDQVIVQRSLSAKSLSHAKGGSVLGGYLKILPMFFIVMPGMISR
ALFPDEVGCVDPDVCQRICGARVGCSNIAYPKLVMALMPVGRGLMIAVIMAALMSSLTSIFNSSSTL
FTIDVWQRFRRKSTEQELMVVGRVFVVFLVVISILWIPIIQSSNSGQLFDYIQAVTSYLAPPITALF

TABLE 29B-continued

NOV29a protein sequence (SEQ ID NO:105)

LLAIFCKRVTEQGAFWGLVFGLGVGLLRMILEFSYPAPACGEVDRRPAVLKDFHYLYFAILLCGLTA
IVIVIVSLCTTPIPEEQASRLTWWTRNCPLSELEKEAPPYFPSVSHHLSPSPTLLSLSFLQSSLPLP
SCSPLSSGFVPPAPSRSWGKLLWSWFCGLSGTPEQALSPAEKAALEQKLTSIEEEPLWRHVCNINAV
LLLAINIFLWGYFA

NOV29b

Alternatively, a NOV29 variant is the novel NOV29b (alternatively referred to herein as CG56557-02), which includes the 797 nucleotide sequence (SEQ ID NO:106) shown in Table 29C. NOV29b was cloned by polymerase chain reaction (PCR) using the primers: 5' GTCAGGACTGAGACAGCTCCACAC 3' (SEQ ID NO:308) and 5' CTGAAGCCAGGTCTGTGGAATCAC 3' (SEQ ID NO:309). Primers were designed based on in silico predictions of the fall length or some portion (one or more exons) of the cDNA/protein sequence of the invention. These primers were used to amplify a cDNA from a pool containing expressed human sequences derived from the following tissues: adrenal gland, bone marrow, brain—amygdala, brain—cerebellum, brain—hippocampus, brain—substantia nigra, brain thalamus, brain—whole, fetal brain, fetal kidney, fetal liver, fetal lung, heart, kidney, lymphoma Raji, mammary gland, pancreas, pituitary gland, placenta, prostate, salivary gland, skeletal muscle, small intestine, spinal cord, spleen, stomach, testis, thyroid, trachea and uterus. The PCR product derived by exon linking, covering the entire open reading frame, was cloned into the pCR2.1 vector from Invitrogen to provide clone 57808::ba252a4.698037.N15.

The NOV29b ORF begins with a Kozak consensus ATG initiation codon at nucleotides 19–21 and ends with a TGA codon at nucleotides 775–777. Putative untranslated regions upstream from the initiation codon and downstream from the termination codon are underlined in Table 29C, and the start and stop codons are in bold letters.

TABLE 29C

NOV29b Nucleotide Sequence (SEQ ID NO:106)

AGCAAGGAGCTGGCAGCAATGGGGCCTGGAGCTTCAGGGGACGGGGTCAGGACTGAGACAGCTCCAC
ACATAGCACTGGACTCCAGAGTTGGTCTGCACGCCTACGACATCAGCGTGGTGGTCATCTACTTTGT
CTTCGTCATTGCTGTGGGGATCTGGTCGTCCATCTTCTGCAAGAGGGTCACAGAGCCCGGAGCTTTC
TGGGGCCTCGTGTTTGGCCTGGGAGTGGGGCTTCTGCGTATGATCCTGGAGTTCTCATACCCAGCGC
CAGCCTGTGGGGAGGTGGACCGGAGGCCAGCAGTGCTGAAGGACTTCCACTACCTGTACTTTGCAAT
CCTCCTCTGCGGGCTCACTGCCATCGTCATTGTCATTGTCAGCCTCTGTACAACTCCCATCCCTGAG
GAACAGCTCACACGCCTCACATGGTGGACTCGGAACTGCCCCCTCTCTGAGCTGGAGAAGGAGGCCC
ACGAGAGCACACCGGAGATATCCGAGAGGCCAGCCGGGGAGTGCCCTGCAGGAGGTGGAGCGGCAGA
GAACTCGAGCCTGGGCCAGGAGCAGCCTGAAGCCCCAAGCAGGTCCTGGGGAAAGTTGCTCTGGAGC
TGGTTCTGTGGGCTCTCTGGAACACCGGAGCAGGCCCTGAGCCCAGCAGAGAAGGCTGCGCTAGAAC
AGAAGCTGACAAGCATTGAGGAGGAGCCACTCTGGAGACATGTCTGCAACATCAATGCTGTCCTTTT
GCTGGCCATCAACATCTTCCTCTGGGGCTATTTTGCGTGATTCCACAGACCTGGCTTCAG

The NOV29b protein (SEQ ID NO:107) encoded by SEQ ID NO:106 is 252 amino acid residues in length is presented using the one-letter code in Table 29D. The Psort profile for NOV29b predicts that this sequence is likely to be localized at the plasma membrane with a certainty of 0.6000. The Signal P predicts a likely cleavage site for a NOV29b peptide is between positions 52 and 53, i.e., at the dash in the sequence IFC-KR.

TABLE 29D

NOV29b protein sequence (SEQ ID NO:107)

MGPGASGDGVRTETAPHIALDSRVGLHAYDISVVVIYFVFVIAVGIWSSIFCKRVTEPGAFWGLVFG
LGVGLLRMILEFSYPAPACGEVDRRPAVLKDFHYLYFAILLCGLTAIVIVIVSLCTTPIPEEQLTRL
TWWTRNCPLSELEKEAHESTPEISERPAGECPAGGGAAENSSLGQEQPEAPSRSWGKLLWSWFCGLS
GTPEQALSPAEKAALEQKLTSIEEEPLWRHVCNINAVLLLAINIFLWGYFA

NOV29c

Alternatively, a NOV29 variant is the novel NOV29c (alternatively referred to herein as CG56557-03), which includes the 2278 nucleotide sequence (SEQ ID NO:108) shown in Table 29E. The NOV29c ORF begins with a Kozak consensus sequence ATG identified at nucleotides 20–22 and ends with a TGA codon at nucleotides 2248–2250. Putative untranslated regions upstream from the initiation codon and downstream from the termination codon are underlined in Table 29E, and the start and stop codons are in bold letters.

TABLE 29E

NOV29c Nucleotide Sequence (SEQ ID NO:108)

<u>GAGCAAGGAGCTGGCAGCA</u>ATGGGGGCCTGGAGCTTCAGGGGACGGGGTCAGGACTGAGACAGCTCCA
CACATAGCACTGGACTCCGGAGTTGGTCTGCACGCCTACGACATCAGCGTGGTGGTCATCTACTTTG
TCTTCGTCATTGCTGTGGGGATCTGGTCGTCCATCCGTGCAAGTCGAGGGACCATTGGCGGCTATTT
CCTGGCCGGGAGGTCCATGAGCTGGTGGCCAATTGGAGCATCTCTGATGTCCAGCAATGTGGGCAGT
GGCTTGTTCATCGGCCTGGCTGGGACAGGGGCTGCCGGAGGCCTTGCCGTAGGTGGCTTCGAGTGGA
ACATGAGGAAATCAAGGTCTGGAGGAGACAGAGGGATCCATCCAAGGTCACACGGGAGGACTGGGGT
CAGGTCCCAGGTCTCTTATTTCTCTGTTCGGGGGCCTCCCACAGCACAGCACTGCCTCTGGGTGGGA
AGCCGCCCCTCTGTCTACATCCAGGACCTGGATACCTTCTTCTTCTCCCCACTCTCCCAGGCAACCT
GGCTGCTCCTGGCCCTTGGCTGGGTCTTCGTCCCTGTGTACATCGCAGCAGGTGTGGTCACAATGCC
GCAGTATCTGAAGAAGCGATTTGGGGGCCAGAGGATCCAGGTGTACATGTCTGTCCTGTCTCTCATC
CTCTACATCTTCACCAAGATCTCGACTGACATCTTCTCTGGAGCCCCCTTCATCCAGATGGCATTGG
GCTGGAACCTGTACCTCTCCACAGGGATCCTGCTGGTGGTGACTGCCGTCTACACCATTGCAGGTGG
CCTCATGGCCGTGATCTACACAGATGCTCTGCAGACGGTGATCATGGTAGGGGGAGCCCTGGTCCTC
ATGTTTCAGGACGTGGGCTGGTACCCAGGCCTGGAGCAGCGGTACAGGCAGGCCATCCCTAATGTCA
CAGTCCCCAACACCACCTGTCACCTCCCACGGCCCGATGCTTTCCACATTCTTCGGGACCCTGTGAG
CGGGGACATCCCTTGGCCAGGTCTCATTTTCGGGCTCACAGTGCTGGCCACCTGGTGTTGGTGCACA
GACCAGGTCATTGTGCAGCGGTCTCTCTCGGCCAAGAGTCTGTCTCATGCCAAGGGAGGCTCCGTGC
TGGGGGGCTACCTGAAGATCCTCCCCATGTTCTTCATCGTCATGCCTGGCATGATCAGCCGGGCCCT
GTTCCCAGACGAGGTGGGCTGCGTGGACCCTGATGTCTGCCAAAGAATCTGTGGGGCCCGAGTGGGA
TGTTCCAACATTGCCTACCCTAAGTTGGTCATGGCCCTCATGCCTGTTGGTCGGGGGCTGATGATTG
CCGTGATCATGGCCGCTCTCATGAGCTCACTCACCTCCATCTTCAACAGCAGCAGCACCCTGTTCAC
CATTGATGTGTGGCAGCGCTTCCGCAGGAAGTCAACAGAGCAGGAGCTGATGGTGGTGGGCAGGGTG
TTTGTGGTGTTCCTGGTTGTCATCAGCATCCTCTGGATCCCCATCATCCAAAGCTCCAACAGTGGGC
AGCTCTTCGACTACATCCAGGCTGTCACCAGTTACCTGGCCCCACCCATCACCGCTCTCTTCCTGCT
GGCCATCTTCTGCAAGAGGGTCACAGAGCAGGGAGCTTTCTGGGGCCTCGTGTTTGGCCTGGGAGTG
GGGCTTCTGCGTATGATCCTGGAGTTCTCATACCCAGCGCCAGCCTGTGGGGAGGTGGACCGGAGGC
CAGCAGTGCTGAAGGACTTCCACTACCTGTACTTTGCAATCCTCCTCTGCGGGCTCACTGCCATCGT
CATTGTCATTGTCAGCCTCTGTACAACTCCCATCCCTGAGGAACAGGCAAGTCGCCTCACATGGTGG
ACTCGGAACTGCCCCCTCTCTGAGCTGGAGAAGGAGGCCCCCCCATACTTTCCATCAGTATCTCACC
ATCTCTCTCCCTCCCCTACTCTCCTATCACTTTCCTTTCTCCAATCTTCTTTGCCTCTCCCCTCCTG
CTCTCCTTTGTCTTCTGGCTTTGTCCCTCCAGCCCCAAGCAGGTCCTGGGGAAAGTTGCTCTGGAGC
TGGTTCTGTGGGCTCTCTGGAACACCGGAGCAGGCCCTGGACCCAGCAGAGAAGGCTGCGCTAGAAC
AGAAGCTGACAAGCATTGAGGAGGAGCCACTCTGGAGACATGTCTGCAACATCAATGCTGTCCTTTT
GCTGGCCATCAACATCTTCCTCTGGGGCTATTTTGCGTGA<u>TTCCACAGACCTGGCTTCAGTGTAGAC</u>

The NOV29c protein (SEQ ID NO:109) encoded by SEQ ID NO:108 is 743 amino acid residues in length is presented using the one-letter code in Table 29F. The Psort profile for NOV29c predicts that this sequence is likely to be localized in the cytoplasm with a certainty of 0.8000. The Signal P predicts a likely cleavage site for a NOV29c peptide is between positions 52 and 53, i.e., at the dash in the sequence IRA-SR.

TABLE 29F

NOV29c protein sequence (SEQ ID NO:109)

MGPGASGDGVRTETAPHIALDSGVGLHAYDISVVVIYFVFVIAVGIWSSIRASRGTIGGYFLAGRSM
SWWPIGASLMSSNVGSGLFIGLAGTGAAGGLAVGGFEWNMRKSRSGGDRGIHPRSHGRTGVRSQVSY
FSVRGPPTAQHCLWVGSRPSVYIQDLDTFFFSPLSQATWLLLALGWVFVPVYIAAGVVTMPQYLKKR
FGGQRIQVYMSVLSLILYIFTKISTDIFSGAPFIQMALGWNLYLSTGILLVVTAVYTIAGGLMAVIY
TDALQTVIMVGGALVLMFQDVGWYPGLEQRYRQAIPNVTVPNTTCHLPRPDAFHILRDPVSGDIPWP
GLIFGLTVLATWCWCTDQVIVQRSLSAKSLSHAKGGSVLGGYLKILPMFFIVMPGMISRALFPDEVG
CVDPDVCQRICGARVGCSNIAYPKLVMALMPVGRGLMIAVIMAALMSSLTSIFNSSSTLFTIDVWQR
FRRKSTEQELMVVGRVFVVFLVVISILWIPIIQSSNSGQLFDYIQAVTSYLAPPITALFLLAIFCKR
VTEQGAFWGLVFGLGVGLLRMILEFSYPAPACGEVDRRPAVLKDFHYLYFAILLCGLTAIVIVIVSL
CTTPIPEEQASRLTWWTRNCPLSELEKEAPPYFPSVSHHLSPSPTLLSLSFLQSSLPLPSCSPLSSG
FVPPAPSRSWGKLLWSWFCGLSGTPEQALSPAEKAALEQKLTSIEEEPLWRHVCNINAVLLLAINIF
LWGYFA

NOV29d

Alternatively, a NOV29 variant is the novel NOV29d (alternatively referred to herein as CG56653-04), which includes the 1969 nucleotide sequence (SEQ ID NO:110) shown in Table 29G. The NOV29d ORF begins with a Kozak consensus ATG initiation codon at nucleotides 18–20 and ends with a TGA codon at nucleotides 847–849. Putative untranslated regions upstream from the initiation codon and downstream from the termination codon are underlined in Table 29G, and the start and stop codons are in bold letters.

NOV29e

Alternatively, a NOV29 variant is the novel NOV29e (alternatively referred to herein as CG56557-05), which includes the 2162 nucleotide sequence (SEQ ID NO:112) shown in Table 29I. The NOV29e ORF begins with a Kozak consensus ATG initiation codon at nucleotides 21–23 and ends with a TAG codon at nucleotides 2133–2135. Putative untranslated regions upstream from the initiation codon and downstream from the termination codon are underlined in Table 29I, and the start and stop codons are in bold letters.

TABLE 29G

NOV29d Nucleotide Sequence (SEQ ID NO:110)

<u>AGCAAGGAGCTGGCAGCA</u>ATGGGGGCCTGGAGCTTCAGGGGACGGGGTCAGGACTGAGACAGCTCCAC
ACATAGCACTGGACTCCAGAGTTGGTCTGCACGCCTACGACATCAGCGTGGTGGTCATCTACTTTGT
CTTCGTCATTGTTGTGGGGATCTGGTCGTCCATCCGTGCAAGTCGAGGGACCATTGGCGGCTATTTC
CTGGCCCCACCCATCACCGCTCTCTTCCTGCTGGCCATCTTCTGCAAGAGGGTCACAGAGCCCGGAG
CTTTCTGGGGCCTCGTGTTTGGCCTGGGAGTGGGGCTTCTGCGTATGATCCTGGAGTTCTCATACCC
AGCGCCAGCCTGTGGGGAGGTGGACCGGAGGCCAGCAGTGCTGAAGGACTTCCACTACCTGTACTTT
GCAATCCTCCTCTGCGGGCTCACTGCCATCGTCATTGTCATTGTCAGCCTCTGTACAACTCCCATCC
CTGAGGAACAGCTCACACGCCTCACATGGTGGACTCGGAACTGCCCCCTCTCTGAGCTGGAGAAGGA
GGCCCACGAGAGCACACCGGAGATATCCGAGAGGCCAGCCGGGGAGTGCCCTGCAGGAGGTGGAGCG
GCAGAGAACTCGAGCCTGGGCCAGGAGCAGCCTGAAGCCCAAGCAGGTCCTGGGGAAAGTTGCTCT
GGAGCTGGTTCTGTGGGCTCTCTGGAACACCGGAGCAGGCCCTGAGCCCAGCAGAGAAGGCTGCGCT
AGAACAGAAGCTGACAAGCATTGAGGAGGAGCCACTCTGGAGACATGTCTGCAACATCAATGCTGTC
CTTTTGCTGGCCATCAACATCTTCCTCTGGGGCTATTTTGCGTGA<u>TTCCACAGACCTGGCTTCAGTG
TAGACAGATTAAACAAAGCCCAAGCCTGTCAGCCACAGAAACAGGCTCTCCTCTTACTTTGCTGTCT
AAACTGGAGATCACAGAAGTCAAGACTGCAAGCTCCCCTGAAGAGAATCCAACTCAACCTGCACACT
TGACAAGTGGAGAAACAGAAGCTCAGAGAGAGCACTGGGTTTGTTCAGGACCACCCAGAAGGTGTCA
CACGGGGTTTCCCCACTCTTTCTGATATATTGCCTTACAGACCTACCTCAAACACACTGTTTCCACC
CTCTTCTTGAATGTATTCAGTAGCCTTTACTGAATGTGTGTGTTGAGAGTAGAAAAAATGGAGGATAC
AAGAAAAGGAGCAGGAAGAAAATTTGCAAAAATCCAAGAGCACCTTTGCTCCCCCTTATCCTCCTTCC
TCTTCCCCTTTCTAGTTCCCCTACCTCTCTATCTTTCTATTCTCACCAATAATCTCTTTGTTGCATG
AATTTACCCAGGAGAGTCCTATATTTCCATTGGTGGCTCCACAGTGGTGGCTGTCAGACCCGAAGGG
GTGGGGAGCCAAGGGTGGACTTTAAGCATGGTGACAGATGGTATTTTGGGCAGAAAGCTCTTAGACA
ATGGACTATCCAAAGCACTATTTAAATTCTGCCTCTTCCTACTCTCTAACCCAAATATGCACAAACT
CTCTATGGCCTTGAGAAGCAGTTGGAGAGACATGACTTGTTAAAACCTCAAGGAATCAAGACATGTT
ACTCTGTATTTAAGGGTAAGCCCCACAGCGGGCAGCACAAACAGCCTGGGAGCCACTGTGCCTGTGC
TTCTCTGTCCTTCTCCCTTTGCTTGCCATGAATCCGCATACCTTGGAATACACTGTGACCCCAGTTA
AGTGTCCCTTCGCCAGGAAGCTGCCGCAACGTCCACACCTGGGTCAAGTTCCCACTCCTGCTCCCAT
AGCCTTGACCTGCTTCTGTCACAGCACTGATCACACTGAGATGGAAGACTCCAGGGGGCAAGGACCA
AGGGCCATATCCCAAGTGACTTTGTACCCAGAAAATAACAGCTGTTCAATAAATGTGTATTGAGTTA
ATTAGTTAAAAAAAAAAAAAAAAAAAA</u>

The NOV29d protein (SEQ ID NO:111) encoded by SEQ ID NO:110 is 276 amino acid residues in length is presented using the one-letter code in Table 29H. The Psort profile for NOV29d predicts that this sequence is likely to be localized at the plasma membrane with a certainty of 0.6000. The Signal P predicts a likely cleavage site for a NOV29d peptide is between positions 52 and 53, i.e., at the dash in the sequence IRA-SR.

TABLE 29H

NOV29d protein sequence (SEQ ID NO: 111)

MGPGASGDGVRTETAPHIALDSRVGLHAYDISVVVIYFVFVIVVGIWSSIRASRGTIGGYFLAPPIT
ALFLLAIFCKRVTEPGAFWGLVFGLGVGLLRMILEFSYPAPACGEVDRRPAVLKDFHYLYFAILLCG
LTAIVIVISLCTTPIPEEQLTRLTWWTRNCPLSELEKEAHESTPEISERPAGECPAGGGAAENSSL
GQEQPEAPSRSWGKLLWSWFCGLSGTPEQALSPAEKAALEQKLTSIEEEPLWRHVCNINAVLLLAIN
IFLWGYFA

TABLE 29I

NOV29e Nucleotide Sequence (SEQ ID NO: 112)

<u>TGAGCAAGGAGCTGGCAGCA</u>ATGGGGCCTGGAGCTTCAGGGGACGGGGTCAGGACTGAGACAGCTCC
ACACATAGCACTGGACTCCAGAGTTGGTCTGCACGCCTACGACATCAGCGTGGTGGTCATCTACTTT
GTCTTCGTCATTGCTGTGGGGATCTGGTCGTCCATCCGTGCAAGTCGAGGGACCATTGGCGGCTATT
TCCTGGCCGGGAGGTCCATGAGCTGGCGGCCAATTGGAGCATCTCTGATGTCCAGCAATGTGGGCAG
TGGCTTGTTCATCGGCCTGGCTGGGACAGGGGCTGCCGGAGGCCTTGCCGTAGGTGGCTTCGAGTGG
AACATGAGGAAATCAAGGTCTGGAGGAGACAGAGGGATCCATCCAAGGTCACACGGGAGGACTGGGG
TCAGGTCCCAGGCAACCTGGCTGCTCCTGGCCCTTGGCTGGGTCTTCGTCCCTGTGTACATCGCAGC
AGGTGTGGTCACAATGCCGCAGTATCTGAAGAAGCGATTTGGGGGCCAGAGGATCCAGGTGTACATG
TCTGTCCTGTCTCTCATCCTCTACATCTTCACCAAGATCTCGACTGACATCTTCTCTGGAGCCCTCT
TCATCCAGATGGCATTGGGCTGGAACCTGTACCTCTCCACAGGGATCCTGCTGGTGGTGACTGCCGT
CTACACCATTGCAGGTGGCCTCATGGCCGTGATCTACACAGATGCTCTGCAGACGGTGATCATGGTA
GGGGGAGCCCTGGTCCTCATGTTTCAGGACGTGGGCTGGTACCCAGGCCTGGAGCAGCGGTACAGGC
AGGCCATCCCTAATGTCACAGTCCCCAACACCACCTGTCACCTCCCACGGCCCGATGCTTTCCACAT
TCTTCGGGACCCTGTGAGCGGGGACATCCCTTGGCCAGGTCTCATTTTCGGGCTCACAGTGCTGGCC
ACCTGGTGTTGGTGCACAGACCAGGTCATTGTGCAGCGGTCTCTCTCGGCCAAGAGTCTGTCTCATG
CCAAGGGAGGCTCCGTGCTGGGGGGCTACCTGAAGATCCTCCCCATGTTCTTCATCGTCATGCCTGG
CATGATCAGCCGGGCCCTGTTCCCAGACGAGGTGGGCTGCGTGGACCCTGATGTCTGCCAAAGAATC
TGTGGGGCCCGAGTGGGATGTTCCAACATTGCCTACCCTAAGTTGGTCATGGCCCTCATGCCTGTTG
GTCGGGGGCTGATGATTGCCGTGATCATGGCCGCTCTCATGAGCTCACTCACCTCCATCTTCAACAG
CAGCAGCACCCTGTTCACCATTGATGTGTGGCAGCGCTTCCGCAGGAAGTCAACAGAGCAGGAGCTG
ATGGTGGTGGGCAGGGTGTTTGTGGTGTTCCTGGTTGTCATCAGCATCCTCTGGATCCCCATCATCC
AAAGCTCCAACAGTGGGCAGCTCTTCGACTACATCCAGGCTGTCACCAGTTACCTGGCCCCACCCAT
CACCGCTCTCTTCCTGCTGGCCATCTTCTGCAAGAGGGTCACAGAGCAGGGAGCTTTCTGGGGCCTC
GTGTTTGGCCTGGGAGTGGGGCTTCTGCGTATGATCCTGGAGTTCTCATACCCAGCGCCAGCCTGTG
GGGAGGTGGACCGGAGGCCAGCAGTGCTGAAGGACTTCCACTACCTGTACTTTGCAATCCTCCTCTG
CGGGCTCACTGCCCATCGTCATTGTCATTGTCAGCCTCTGTACAACTCCCATCCCTGAGGAACAGGCA
AGTCGCCTCACATGGTGGACTCGGAACTGCCCCCTCTCTGAGCTGGAGAAGGAGGCCCCCCCATACT
TTCCATCAGTATCTCACCATCTCTCTCCCTCCCCTACTCTCCTATCACTTTCCTTTCTCCAATCTTC
TTTGCCTCTCCCCTCCTGCTCTCCTTTGTCTTCTGGCTTTGTCCCTCCAGCCCCAAGCAGGTCCTGG
GGAAAGTTGCTCTGGAGCTGGTTCTGTGGGCTCTCTGGAACACCGGAGCAGGCCCTGAGCCCAGCAG
AGAAGGCTGCGCTAGAACAGAAGCTGACAAGCATTGAGGAGGAGCCACTCTGGAGACATGTCTGCAA
CATCAATGCTGTCCTTTTGCTGGCCATCAACATCTTCCTCTGGGGCTATTTTGCGTGA<u>TTCCACAGA
CCTGGCTTCAGTGTAGAC</u>

The NOV29e protein (SEQ ID NO:113) encoded by SEQ ID NO:112 is 704 amino acid residues in length is presented using the one-letter code in Table 29J. The Psort profile for NOV29e predicts that this sequence is likely to be localized at the plasma membrane with a certainty of 0.8000. The Signal P predicts a likely cleavage site for a NOV29e peptide is between positions 52 and 53, i.e., at the dash in the sequence IRA-SR.

TABLE 29J

NOV29e protein sequence (SEQ ID NO: 113)

MGPGASGDGVRTETAPHIALDSRVGLHAYDISVVVIYFVFVIAVGIWSSIRASRGTIGGYFLAGRSM
SWRPIGASLMSSNVGSGLFIGLAGTGAAGGLAVGGFEWNMRKSRSGGDRGIHPRSHGRTGVRSQATW
LLLALGWVFVPVYIAAGVVTMPQYLKKRFGGQRIQVYMSVLSLILYIFTKISTDIFSGALFIQMALG
WNLYLSTGILLVVTAVYTIAGGLMAVIYTDALQTVIMVGGALVLMFQDVGWYPGLEQRYRQAIPNVT
VPNTTCHLPRPDAFHILRDPVSGDIPWPGLIFGLTVLATWCWCTDQVIVQRSLSAKSLSHAKGGSVL
GGYLKILPMFFIVMPGMISRALFPDEVGCVDPDVCQRICGARVGCSNIAYPKLVMALMPVGRGLMIA
VIMAALMSSLTSIFNSSSTLFTIDVWQRFRRKSTEQELMVVGRVFVVFLVVISILWIPIIQSSNSGQ
LFDYIQAVTSYLAPPITALFLLAIFCKRVTEQGAFWGLVFGLGVGLLRMILEFSYPAPACGEVDRRP
AVLKDFHYLYFAILLCGLTAIVIVIVSLCTTPIPEEQASRLTWWTRNCPLSELEKEAPPYFPSVSHH
LSPSPTLLSLSFLQSSLPLPSCSPLSSGFVPPAPSRSWGKLLWSWFCGLSGTPEQALSPAEKAALEQ
KLTSIEEEPLWRHVCNINAVLLLAINIFLWGYFA

NOV29f

Alternatively, a NOV29 variant is the novel NOV29f (alternatively referred to herein as CG56557-06), which includes the 875 nucleotide sequence (SEQ ID NO:114) shown in Table 29K. NOV25e was cloned by the polymerase chain reaction (PCR) using the primers: 5' GTCAGGACTGAGACAGCTCCACAC 3' (SEQ ID NO:310) and 5' CTGAAGCCAGGTCTGTGGAATCAC 3' (SEQ ID NO:311). Primers were designed based on in silico predictions of the full length or some portion (one or more exons) of the cDNA/protein sequence of the invention. These primers were used to amplify a cDNA from a pool containing expressed human sequences derived from the following tissues: adrenal gland, bone marrow, brain—amygdala, brain—cerebellum, brain—hippocampus, brain—substantia nigra, brain thalamus, brain—whole, fetal brain, fetal kidney, fetal liver, fetal lung, heart, kidney, lymphoma Raji, mammary gland, pancreas, pituitary gland, placenta, prostate, salivary gland, skeletal muscle, small intestine, spinal cord, spleen, stomach, testis, thyroid, trachea and uterus. The PCR product derived by exon linking, covering the entire open reading frame, was cloned into the pCR2.1 vector from Invitrogen to provide clone 57808::ba252a4.698037.N1.

The NOV29f ORF begins with a Kozak consensus ATG initiation codon at nucleotides 19–21 and ends with a TGA codon at nucleotides 847–849. Putative untranslated regions upstream from the initiation codon and downstream from the termination codon are underlined in Table 29K, and the start and stop codons are in bold letters.

TABLE 29K

NOV29f Nucleotide Sequence (SEQ ID NO: 114)

AGCAAGGAGCTGGCAGCAATGGGGCCTGGAGCTTCAGGGGACGGGGTCAGGACTGAGACAGCTCCAC
ACATAGCACTGGACTCCAGAGTTGGTCTGCACGCCTACGACATCAGCGTGGTGGTCATCTACTTTGT
CTTCGTCATTGTTGTGGGGATCTGGTCGTCCATCCGTGCAAGTCGAGGGACCATTGGCGGCTATTTC
CTGGCCCCACCCATCACCGCTCTCTTCCTGCTGGCCATCTTCTGCAAGAGGGTCACAGAGCCCGGAG
CTTTCTGGGGCCTCGTGTTTGGCCTGGGAGTGGGGCTTCTGCGTATGATCCTGGAGTTCTCATACCC
AGCGCCAGCCTGTGGGGAGGTGGACCGGAGGCCAGCAGTGCTGAAGGACTTCCACTACCTGTACTTT
GCAATCCTCCTCTGCGGGCTCACTGCCATCGTCATTGTCATTGTCAGCCTCTGTACAACTCCCATCC
CTGAGGAACAGCTCACACGCCTCACATGGTGGACTCGGAACTGCCCCCTCTCTGAGCTGGAGAAGGA
GGCCCACGAGAGCACACCGGAGATATCCGAGAGGCCAGCCGGGGAGTGCCCTGCAGGAGGTGGAGCG
GCAGAGAACTCGAGCCTGGGCCAGGAGCAGCCTGAAGCCCCAAGCAGGTCCTGGGGAAAGTTGCTCT
GGAGCTGGTTCTGTGGGCTCTCTGGAACACCGGAGCAGGTCCTGAGCCCAGCAGAGAAGGCTGCGCT
AGAACAGAAGCTGACAAGCATTGAGGAGGAGCCACTCTGGAGACATGTCTGCAACATCAATGCTGTC
CTTTTGCTGGCCATCAACATCTTCCTCTGGGGCTATTTTGCGTGATTCCACAGACCTGGCTTCAGTG
TAGA

Variant sequences of NOV29f are included in Example 2. A variant sequence can include a single nucleotide polymorphism (SNP).

The NOV29f protein (SEQ ID NO:115) encoded by SEQ ID NO:114 is 319 amino acid residues in length is presented using the one-letter code in Table 29L. The Psort profile for NOV29f predicts that this sequence is likely to be localized at the plasma membrane with a certainty of 0.6000. The Signal P predicts a likely cleavage site for a NOV29f peptide is between positions 52 and 53, i.e., at the dash in the sequence IRA-SR.

TABLE 29L

NOV29f protein sequence (SEQ ID NO: 115)

MGPGASGDGVRTETAPHIALDSRVGLHAYDISVVVIYFVFVIVVGIWSSIRASRGTIGGYFLAPPIT
ALFLLAIFCKRVTEPGAFWGLVFGLGVGLLRMILEFSYPAPACGEVDRRPAVLKDFHYLYFAILLCG
LTAIVIVIVSLCTTPIPEEQLTRLTWWTRNCPLSELEKEAHESTPEISERPAGECPAGGGAAENSSL
GQEQPEAPSRSWGKLLWSWFCGLSGTPEQVLSPAEKAALEQKLTSIEEEPLWRHVCNINAVLLLAIN
IFLWGYFA

NOV29 Clones

Unless specifically addressed as NOV29a, NOV29b, NOV29c, NOV29d, NOV29e, or NOV29f, any reference to NOV29 is assumed to encompass all variants. Further, Patp, BLAST, and DOMAIN analyses are presented for NOV29c, the longest NOV29 polypeptide sequence.

A search against the Patp database, a proprietary database that contains sequences published in patents and patent publications, yielded several homologous proteins shown in Table 29M.

TABLE 29M

Patp results for NOV29

| Sequences producing High-scoring Segment Pairs: | Reading Frame | High Score | Smallest Sum Prob P (N) |
|---|---|---|---|
| >patp: AAE06614 Human protein | +1 | 1567 | 1.4e-199 |
| >patp: AAE08088 Human transporter-related protein #35 | +1 | 1567 | 1.4e-199 |
| >patp: AAR73595 Cotransporter protein SGLT1 | +1 | 1474 | 4.1e-196 |
| >patp: AAR73593 Cotransporter protein SNST1 | +1 | 1508 | 1.1e-185 |
| >patp: AAB60093 Human transport protein TPPT-13 | +1 | 1531 | 2.7e-184 |

NOV29 polypeptides are ficolin-like proteins with sequence homology to the Fibrinogen protein family. In a BLAST search of public sequence databases, it was found, for example, that the NOV29c nucleic sequence of this invention has 660 of 938 bases (70%) identical to a gb:GEN-BANK-ID:RNU03120|acc:U03120.1 *Rattus norvegicus* (Sprague-Dawley sodium glucose cotransporter 1 mRNA, complete cds—*Rattus norvegicus*, 2627 bp). The full NOV29c polypeptide sequence was found to have 401 of 446 amino acid residues (89%) identical to, and 401 of 446 amino acid residues (91%) similar to, the 552 amino acid residue gi|9588428|emb|CAC00574.1| (AL109659) dJ1024N4.1 (novel Sodium:solute symporter family member similar to SLC5A1 (SGLT1)) from *Homo sapiens*.

Additional BLAST results are shown in Table 25N.

TABLE 29N

BLAST results for NOV29

| Gene Index/Identifier | Protein/Organism | Length (aa) | Identity (%) | Positives (%) | Expect |
|---|---|---|---|---|---|
| gi|9588428|emb|CAC00574.1| (AL109659) | dJ1024N4.1 (novel Sodium: solute symporter family member similar to SLC5A1 (SGLT1)) [*Homo sapiens*] | 552 | 401/446 (89%) | 401/446 (89%) | 0.0 |
| gi|631592|pir||S48857 | glucose transport protein - sheep | 530 | 285/579 (49%) | 367/579 (63%) | 1e-149 |
| gi|1709219|sp|P53791| | SL51_SHEEP SODIUM/ GLUCOSE COTRANSPORTER 1 (NA(+)/GLUCOSE COTRANS- PORTER 1) (HIGH AFFINITY SODIUM-GLUCOSE COTRANS- PORTER) | 664 | 285/579 (49%) | 367/579 (63%) | 1e-148 |
| gi|631593|pir||S48858 | glucose transport protein homolog - sheep | 664 | 284/579 (49%) | 368/579 (63%) | 1e-148 |
| gi|6563312|gb|AAF17249.1|AF208031_1 (AF208031) | SGLT1 protein [*Mus musculus*] | 665 | 282/579 (48%) | 367/579 (62%) | 1e-144 |

A multiple sequence alignment is given in Table 29O, with the NOV29 protein of the invention being shown on line 1, in a ClustalW analysis comparing NOV29 with related protein sequences disclosed in Table 25N.

Table 29O. Information for the ClustalW proteins:

1. >NOV29a; SEQ ID NO:105
2. >NOV29b; SEQ ID NO:107
3. >NOV29c; SEQ ID NO:109
4. >NOV29d; SEQ ID NO:111
5. >NOV29e; SEQ ID NO:113
6. >NOV29f; SEQ ID NO:115
7. >GI|9588428/ dJ1022N4.1 (sodium:solute symporter family member) [*Homo sapiens*]; SEQ ID NO:312
8. >GI|631592|/ glucose transport protein [sheep]; SEQ ID NO:313
9. >GI|1709219/ SL51_Sheep sodium/glucose cotransporter 1 [sheep]; SEQ ID NO:314
10. >GI|631593|/glucose transport protein homologue [sheep]; SEQ ID NO:315
11. >GI|6563312/SGLT1 protein [*Mus musculus*]; SEQ ID NO:316

```
                        10         20         30         40         50
                ....|....|....|....|....|....|....|....|....|....|
        NOV29a  MSKELAAMGPGASGDGVRTETAPHIALDSRVGLHAYDISVVVIYFVFVIA
        NOV29b  -------MGPGASGDGVRTETAPHIALDSRVGLHAYDISVVVIYFVFVIA
        NOV29c  -------MGPGASGDGVRTETAPHIALDSGVGLHAYDISVVVIYFVFVIA
```

```
NOV29d        -------MGPGASGDGVRTETAPHIALDSRVGLHAYDISVVVIYFVFVIV
NOV29e        -------MGPGASGDGVRTETAPHIALDSRVGLHAYDISVVVIYFVFVIA
NOV29f        -------MGPGASGDGVRTETAPHIALDSRVGLHAYDISVVVIYFVFVIV
gi|9588428    -------MGPGASGDGVRTETAPHIALDSRVGLHAYDISVVVIYFVFVIA
gi|631592|    -------MDSSTLSPPATDTAEPLQAYERIR--NAADISVIVIYFVVMA
gi|1709219    -------MDSSTWSPPATATAEPLQAYERIR--NAADISVIVIYFVVMA
gi|631593|    -------MDSSTWSPPATATAEPLQAYERIR--NAADISVIVIYFVVMA
gi|6563312    -------MDSSTLSPAVTATDAPIPSYERIR--NAADISVIVIYFVVMA 60        70        80        90       100
                ....|....|....|....|....|....|....|....|....|....|
NOV29a        VGIWSSIRASRGTIGGYFLAGRSMSWWPVGASLMSSNVGSGLFIGLAGTG
NOV29b        VGIWS---------------------------------------------
NOV29c        VGIWSSIRASRGTIGGYFLAGRSMSWWPIGASLMSSNVGSGLFIGLAGTG
NOV29d        VGIWSSIRASRGTIGGYFLA------------------------------
NOV29e        VGIWSSIRASRGTIGGYFLAGRSMSWRPIGASLMSSNVGSGLFIGLAGTG
NOV29f        VGIWSSIRASRGTIGGYFLA------------------------------
gi|9588428    VGIWSSIRASRGTIGGYFLAGRSMSWWPIGASLMSSNVGSGLFIGLAGTG
gi|631592|    VGLWHMFSTNRGTVGGFFLAGRSMVWWPIGASLFASNIGSGHFVGLAGTG
gi|1709219    VGLWAMFSTNRGTVGGFFLAGRSMVWWPIGASLFASNIGSGHFVGLAGTG
gi|631593|    VGLWAMFSTNRGTVGGFFLAGRSMVWWPIGASLFASNIGSGHFVGLAGTG
gi|6563312    VGLWAMFSTNRGTVGGFFLAGRSMVWWPIGASLFASNIGSGHFVGLAGTG 110       120       130       140       150
                ....|....|....|....|....|....|....|....|....|....|
NOV29a        AAGGLAVGGFEWNVRK----------------------------------
NOV29b        --------------------------------------------------
NOV29c        AAGGLAVGGFEWNMRKSRSGGDRGIHPRSHGRTGVRSQVSYFSVRGPPTA
NOV29d        --------------------------------------------------
NOV29e        AAGGLAVGGFEWNMRKSRSGGDRGIHPRSHGRTGVR--------------
NOV29f        --------------------------------------------------
gi|9588428    AAGGLAVGGFEWN-------------------------------------
gi|631592|    AAAGIATGGFEWN-------------------------------------
gi|1709219    AAAGIATGGFEWN-------------------------------------
gi|631593|    AAAGIATGGFEWN-------------------------------------
gi|6563312    AAAGIAMGGFEWN-------------------------------------

160       170       180       190       200
                ....|....|....|....|....|....|....|....|....|....|
NOV29a        ----------------------------LAWFLVFVPVYIAAGVVT
NOV29b        ----------------------------------------------
NOV29c        QHCLWVGSRPSVYIQDLDTFFFSPLSQATWLLLALGWVFVPVYIAAGVVT
NOV29d        ---------------------------------------P---------
NOV29e        ----------------------SQATWLLLALGWVFVPVYIAAGVVT
NOV29f        ---------------------------------------P---------
gi|9588428    --------------------------ATWLLLALGWVFVPVYIAAGVVT
gi|631592|    --------------------------ALILVVLLGWVFVPIYIKAGVVT
gi|1709219    --------------------------ALILVVLLGWVFVPIYIKAGVVT
gi|631593|    --------------------------ALILVVLLGWVFVPIYIKAGVVT
gi|6563312    --------------------------ALVLVVVLGWIFVPIYIKAGVVT 210       220       230       240       250
                ....|....|....|....|....|....|....|....|....|....|
NOV29a        MPQYLKKRFGGQRIQVYMSVLSLILYIFTKISVDIFSGALFIQMALGWNL
NOV29b        --------------------------------------------------
NOV29c        MPQYLKKRFGGQRIQVYMSVLSLILYIFTKISTDIFSGAPFIQMALGWNL
NOV29d        --------------------------------------------------
NOV29e        MPQYLKKRFGGQRIQVYMSVLSLILYIFTKISTDIFSGALFIQMALGWNL
NOV29f        --------------------------------------------------
gi|9588428    MPQYLKKRFGGQRIQVYMSVLSLILYIFTKISTDIFSGALFIQMALGWN-
gi|631592|    MPEYLRKRFGGQRIQVYLSVLSLVLYIFTKISADIFSGAIFINLALG---
gi|1709219    MPEYLRKRFGGQRIQVYLSVLSLVLYIFTKISADIFSGAIFINLALG---
gi|631593|    MPEYLRKRFGGQRIQVYLSVLSLVLYIFTKISADIFSGAIFINLALG---
```

```
gi|6563312   MPEYLRKRFGGKRIQIYLSVLSLLYIFTKISADIFSGAIFINLALG---

260        270        280        290        300
                ....|....|....|....|....|....|....|....|....|....|
NOV29a          YLSTG---------------ILLVVTAVYTIAGGLMAVIYTDALQTVI
NOV29b          ------------------------------------------------
NOV29c          YLSTG---------------ILLVVTAVYTIAGGLMAVIYTDALQTVI
NOV29d          ------------------------------------------------
NOV29e          YLSTG---------------ILLVVTAVYTIAGGLMAVIYTDALQTVI
NOV29f          ------------------------------------------------
gi|9588428      ------------------------------------------------
gi|631592|      ------------------------------------------------
gi|1709219      ------------------------------------------------
gi|631593|      ------------------------------------------------
gi|6563312      ------------------------------------------------

310        320        330        340        350
                ....|....|....|....|....|....|....|....|....|....|
NOV29a          MVGGALVLMFQDVGWYPGLEQRYRQAIPNVTVPNTTCHLPRPDAFHILRD
NOV29b          -------------------------------------------------
NOV29c          MVGGALVLMFQDVGWYPGLEQRYRQAIPNVTVPNTTCHLPRPDAFHILRD
NOV29d          -------------------------------------------------
NOV29e          MVGGALVLMFQDVGWYPGLEQRYRQAIPNVTVPNTTCHLPRPDAFHILRD
NOV29f          -------------------------------------------------
gi|9588428      -------------------------------------------------
gi|631592|      -------------------------------------------------
gi|1709219      -------------------------------------------------
gi|631593|      -------------------------------------------------
gi|6563312      -------------------------------------------------

360        370        380        390        400
                ....|....|....|....|....|....|....|....|....|....|
NOV29a          PVSGDIPWPGLIFGLTVLATWCWCTDQVIVQRSLSAKSLSHAKGGSVLGG
NOV29b          -------------------------------------------------
NOV29c          PVSGDIPWPGLIFGLTVLATWCWCTDQVIVQRSLSAKSLSHAKGGSVLGG
NOV29d          -------------------------------------------------
NOV29e          PVSGDIPWPGLIFGLTVLATWCWCTDQVIVQRSLSAKSLSHAKGGSVLGG
NOV29f          -------------------------------------------------
gi|9588428      -------------------------------------------------
gi|631592|      -------------------------------------------------
gi|1709219      -------------------------------------------------
gi|631593|      -------------------------------------------------
gi|6563312      -------------------------------------------------

410        420        430        440        450
                ....|....|....|....|....|....|....|....|....|....|
NOV29a          YLKILPMFFIVMPGMISRALFPDEVGCVDPDVCQRICGARVGCSNIAYPK
NOV29b          -------------------------------------------------
NOV29c          YLKILPMFFIVMPGMISRALFPDEVGCVDPDVCQRICGARVGCSNIAYPK
NOV29d          -------------------------------------------------
NOV29e          YLKILPMFFIVMPGMISRALFPDEVGCVDPDVCQRICGARVGCSNIAYPK
NOV29f          -------------------------------------------------
gi|9588428      -------------------------------------------------
gi|631592|      -------------------------------------------------
gi|1709219      -------------------------------------------------
gi|631593|      -------------------------------------------------
gi|6563312      -------------------------------------------------

460        470        480        490        500
                ....|....|....|....|....|....|....|....|....|....|
NOV29a          LVMALMPVGRGLMIAVIMAALMSSLTSIFNSSSTLFTIDVWQRFRRKSTE
NOV29b          -------------------------------------------------
NOV29c          LVMALMPVGRGLMIAVIMAALMSSLTSIFNSSSTLFTIDVWQRFRRKSTE
```

```
NOV29d       ------------------------------------------------
NOV29e       LVMALMPVGRGLMIAVIMAALMSSLTSIFNSSSTLFTIDVWQRFRRKSTE
NOV29f       ------------------------------------------------
gi|9588428   ------------------------------------------------
gi|631592|   ------------------------------------------------
gi|1709219   ------------------------------------------------
gi|631593|   ------------------------------------------------
gi|6563312   ------------------------------------------------

510        520        530        540        550
                ....|....|....|....|....|....|....|....|....|....|
NOV29a       QELMVVGRVFVVFLVVISILWIPIIQSSNSGQLFDYIQAVTSYLAPPITA
NOV29b       --------------------------------------------------
NOV29c       QELMVVGRVFVVFLVVISILWIPIIQSSNSGQLFDYIQAVTSYLAPPITA
NOV29d       ---------------------------------------------PITA
NOV29e       QELMVVGRVFVVFLVVISILWIPIIQSSNSGQLFDYIQAVTSYLAPPITA
NOV29f       ---------------------------------------------PITA
gi|9588428   ---------------------------------------------LYLS
gi|631592|   ---------------------------------------------LDLYLA
gi|1709219   ---------------------------------------------LDLYLA
gi|631593|   ---------------------------------------------LDIYLA
gi|6563312   ---------------------------------------------LDIYLA 560        570        580        590        600
                ....|....|....|....|....|....|....|....|....|....|
NOV29a       LFLLAIFCKRVTEQGAFWGLVFG--------LGVGLLRMILEFS----YP
NOV29b       ----SIFCKRVTEPGAFWGLVFG--------LGVGLLRMILEFS----YP
NOV29c       LFLLAIFCKRVTEQGAFWGLVFG--------LGVGLLRMILEFS----YP
NOV29d       LFLLAIFCKRVTEPGAFWGLVFG--------LGVGLLRMILEFS----YP
NOV29e       LFLLAIFCKRVTEQGAFWGLVFG--------LGVGLLRMILEFS----YP
NOV29f       LFLLAIFCKRVTEPGAFWGLVFG--------LGVGLLRMILEFS----YP
gi|9588428   TGILVVTAVYTIAGGLMAVIYTDALQTVIMVGGALVLMFLGFQDVGWYP
gi|631592|   IFILLAITALYTITGGLAAVIYTDTLQTVIMLLGSFILTGFAFHEVGGYS
gi|1709219   IFILLAITALYTITGGLAAVIYTDTLQTVIMLLGSFILTGFAFHEVGGYS
gi|631593|   IFILLAITALYTITGGLAAVIYTDTLQTVIMLLGSFILTGFAFHEVGGYS
gi|6563312   IFILLAITALYTITGGLAAVIYTDTLQTAIMLVGSFILTGFAFNEVGGYE 610        620        630        640        650
                ....|....|....|....|....|....|....|....|....|....|
NOV29a       ------APACGEVDR-------------RP---AVLKD----------F
NOV29b       ------APACGEVDR-------------RP---AVLKD----------F
NOV29c       ------APACGEVDR-------------RP---AVLKD----------F
NOV29d       ------APACGEVDR-------------RP---AVLKD----------F
NOV29e       ------APACGEVDR-------------RP---AVLKD----------F
NOV29f       ------APACGEVDR-------------RP---AVLKD----------F
gi|9588428   GLEQRYRQAIPNVTVP-----NTTCHLPRPDAFHILRDPVSGDIPWPGLI
gi|631592|   AFVTKYMNAIPTVTSYGNTTVKKECYTPRADSFHIFRDPLKGDLPWPGLI
gi|1709219   AFVTKYMNAIPTVTSYGNTTVKKECYTPRADSFHIFRDPLKGDLPWPGLI
gi|631593|   AFVRKYMNAIPTVTSYGNTTVKKECYTPRADSFHIFRDPLKGDLPWPGLI
gi|6563312   AFMDKYMKAIPTKVSNGNFTAKEECYTPRADSFHIFRDPITGDMPWPGLI 660        670        680        690        700
                ....|....|....|....|....|....|....|....|....|....|
NOV29a       HYLYFAILLCGLTAIVIVIVSLCTTPIPEEQ--------ASRLTWWTRNC
NOV29b       HYLYFAILLCGLTAIVIVIVSLCTTPIPEEQ--------LTRLTWWTRNC
NOV29c       HYLYFAILLCGLTAIVIVIVSLCTTPIPEEQ--------ASRLTWWTRNC
NOV29d       HYLYFAILLCGLTAIVIVIVSLCTTPIPEEQ--------LTRLTWWTRNC
NOV29e       HYLYFAILLCGLTAIVIVIVSLCTTPIPEEQ--------ASRLTWWTRNC
NOV29f       HYLYFAILLCGLTAIVIVIVSLCTTPIPEEQ--------LTRLTWWTRNC
gi|9588428   FGLTVLATWCWCTDQVIVQRSLSAKSLSHAKGGSVLGGYLKILPMFFIVM
gi|631592|   FGLTIISLWYWCTDQVIVQRCLSAKNMSHVKAGCIMCGYMKLLPMFLMVM
gi|1709219   FGLTIISLWYWCTDQVIVQRCLSAKNMSHVKAGCIMCGYMKLLPMFLMVM
gi|631593|   FGLTIISLWYWCTDQVIVQRCLSAKNMSHVKAGCIMCGYMKLLPMFLMVM
```

```
gi|6563312    FGLAILALWYWCTDQVIVQRCLSAKNMSHVKAGCTLCGYLKLLPMFLMVM 710       720       730       740       750
                  ....|....|....|....|....|....|....|....|....|....|
NOV29a        P----LSELEKEAPPYFPSVSHHLSPS---P-------------TLLSL-
NOV29b        P----LSELEKEAHESTPEISERPAGE---C-------------PAGGG-
NOV29c        P----LSELEKEAPPYFPSVSHHLSPS---P-------------TLLSL-
NOV29d        P----LSELEKEAHESTPEISERPAGE---C-------------PAGGG-
NOV29e        P----LSELEKEAPPYFPSVSHHLSPS---P-------------TLLSL-
NOV29f        P----LSELEKEAHESTPEISERPAGE---C-------------PAGGG-
gi|9588428    PGMISRALFPDEVGCVDPDVCQRICGARVGCSNIAYPKLVMALMPVGLRG
gi|631592|    PGMISRILFTEKVACTVPSECEKYCGTKVGCTNIAYPTLVVELMPNGLRG
gi|1709219    PGMISRILFTEKVACTVPSECEKYCGTKVGCTNIAYPTLVVELMPNGLRG
gi|631593|    PGMISRILFTEKVACTVPSECEKYCGTKVGCTNIAYPTLVVELMPNGLRG
gi|6563312    PGMISRILYTEKIACVLPEECQKYCGTPVGCTNIAYPTLVVELMPNGLRG 760       770       780       790       800
                  ....|....|....|....|....|....|....|....|....|....|
NOV29a        -------SFLQSSLP----------------------LPSCSP-LSSG
NOV29b        -------AAENSSLG----------------------QE---------
NOV29c        -------SFLQSSLP----------------------LPSCSP-LSSG
NOV29d        -------AAENSSLG----------------------QE---------
NOV29e        -------SFLQSSLP----------------------LPSCSP-LSSG
NOV29f        -------AAENSSLG----------------------QE---------
gi|9588428    LMIAVIMAALMSSLTSIFNSSSTLFTIDVWQRFRRKSTEQELMVVGRVFV
gi|631592|    LMLSVMLASLMSSLTSIFNSASTLFTMDIYTKIRKKASEKELMIAGRLFM
gi|1709219    LMLSVMLASLMSSLTSIFNSASTLFTMDIYTKIRKKASEKELMIAGRLFM
gi|631593|    LMLSVMLASLMSSLTSIFNSASTLFTMDIYTKIRKKASEKELMIAGRLFM
gi|6563312    LMLSVMMASLMSSLTSIFNSASTLFTMDIYTKIRKKASEKELMIAGRLFI 810       820       830       840       850
                  ....|....|....|....|....|....|....|....|....|....|
NOV29a        FVPPAPSRSWGKLLWSWFCC-----LSGTPEQALSPAEKAALEQKLTSIE
NOV29b        -QPEAPSRSWGKLLWSWFCG-----LSGTPEQALSPAEKAALEQKLTSIE
NOV29c        FVPPAPSRSWGKLLWSWFCG-----LSGTPEQALSPAEKAALEQKLTSIE
NOV29d        -QPEAPSRSWGKLLWSWFCG-----LSGTPEQALSPAEKAALEQKLTSIE
NOV29e        FVPPAPSRSWGKLLWSWFCG-----LSGTPEQALSPAEKAALEQKLTSIE
NOV29f        -QPEAPSRSWGKLLWSWFCG-----LSGTPEQVLSPAEKAALEQKLTSIE
gi|9588428    VFLVVISILWIPIIQSSNSGQLFDYIQAVTSYLAPPITALFLLAIFCKRV
gi|631592|    LVLIGVSIAWVPIVQSAQSGQLFDYIQSITSYLGPPIAAVFLLAIFCKRV
gi|1709219    LVLIGVSIAWVPIVQSAQSGQLFDYIQSITSYLGPPIAAVFLLAIFCKRV
gi|631593|    LVVIGVSIAWVPIVQSAQSGQLFDYIQSITSYLGPPMRAVFLLAIFCKRV
gi|6563312    LVLIGISIAWVPIVQSAQSGQLFDYIQSITSYLGPPIAAVFLLAIFCKRV 860       870       880       890       900
                  ....|....|....|....|....|....|....|....|....|....|
NOV29a        EEP--LWRHVCNINAVLLLAINIFLWG------------------YFA
NOV29b        EEP--LWRHVCNINAVLLLAINIFLWG------------------YFA
NOV29c        EEP--LWRHVCNINAVLLLAINIFLWG------------------YFA
NOV29d        EEP--LWRHVCNINAVLLLAINIFLWG------------------YFA
NOV29e        EEP--LWRHVCNINAVLLLAINIFLWG------------------YFA
NOV29f        EEP--LWRHVCNINAVLLLAINIFLWG------------------YFA
gi|9588428    TEPGAFWGLVFGLGVGLLRMILEFSYPAPACGEVDRRPAVLKDFHYLYFA
gi|631592|    NEPGAFWGLIIGFLIGVSRMITEFAYGTGSCMEPSNCPTIICGVHYLYFA
gi|1709219    NEPGAFWGLIIGFLIGVSRMITEFAYGTGSCMEPSNCPTIICGVHYLYFA
gi|631593|    NEPGAFWGLIIGFLIGVSRMITEFAYGTGSCMEPSNCPTIICGVHYLYFA
gi|6563312    NEQGAFWGLILGFLIGISRMITEFAYGTGSCMEPSNCPKIICGVHYLYFA
```

The NOV29 Clustal W alignment shown in Table 29O was modified to end at amino residue 900. The data in Table 29O includes all of the regions overlapping with the NOV29 protein sequences.

The presence of identifiable domains in the protein disclosed herein was determined by searches using algorithms such as PROSITE, Blocks, Pfam, ProDomain, Prints and then determining the Interpro number by crossing the domain match (or numbers) using the Interpro website (http:www.ebi.ac.uk/interpro/). Table 29P lists the domain description from DOMAIN analysis results against NOV29c.

TABLE 25P

Domain Analysis of NOV29

| Model | Region of Homology | Score (bits) | E value |
|---|---|---|---|
| Sodium:solute symporter family | 60–549 | 608.2 | 2.6e-180 |
| Integral membrane protein DUF6 | 427–559 | −28.7 | 0.87 |
| 36 KDa capillovirus serine protease (S35) | 429–441 | 2.2 | 0.36 |

Consistent with other known members of the sodium: solute symporter family (SSF), the NOV29 Na+/glucose transporter-like protein contains the sodium:solute symporter family domain and an integral membrane domain as illustrated in Table 25T (Ohashi and Erickson, J. Biol. Chem., 272: 14220–6(1997)). NOV29 nucleic acids, and the encoded polypeptides, according to the invention are useful in a variety of applications and contexts. For example, NOV29 nucleic acids and polypeptides can be used to identify proteins that are members of the sodium:solute symporter family of proteins. The NOV29 nucleic acids and polypeptides can also be used to screen for molecules, which inhibit or enhance NOV29 activity or function. Specifically, the nucleic acids and polypeptides according to the invention may be used as targets for the identification of small molecules that modulate or inhibit, e.g., cellular activation and cellular metabolism. These molecules can be used to treat, e.g., for metabolic diseases such as diabetes and hypertension, or cancer, trauma, regeneration (in vitro and in vivo), viral/bacterial/parasitic infections, diabetes, autoimmune disease, renal artery stenosis, interstitial nephritis, glomerulonephritis, polycystic kidney disease, systemic lupus erythematosus, renal tubular acidosis, IgA nephropathy, hypercalceimia, Lesch-Nyhan syndrome, cirrhosis, transplantation, infertility and other diseases, disorders and conditions of the like.

In addition, various NOV29 nucleic acids and polypeptides according to the invention are useful, inter alia, as novel members of the protein families according to the presence of domains and sequence relatedness to previously described proteins. For example, the NOV29 nucleic acids and their encoded polypeptides include structural motifs that are characteristic of proteins belonging to the SSF family such as the Na+/glucose transporter proteins involved in renal transport and metabolism. (Ohashi and Erickson, J. Biol. Chem., 272: 14220–6(1997)).

Integral membrane proteins that mediate the intake of a wide variety of molecules with the concomitant uptake of sodium ions are grouped into a number of distinct families. One of these families, known as the SSF, consists of integral membrane proteins that are predicted to comprise at least ten membrane spanning domains. Members of the SSF catalyze solute:Na+ symport (Reizer et al.,. Biochem. Biophys. Acta, 1197: 133–166(1994)) can transport sugars, amino acids, nucleosides, inositols, vitamins, urea or anions, depending on the system. Members of the SSF family have been identified in bacteria, archaea and animals, and all functionally well characterized members catalyze solute uptake via Na+ symport.

The NOV29 nucleic acids and polypeptides, antibodies and related compounds according to the invention will be useful in therapeutic and diagnostic applications in the mediation of metabolism and immune function and renal physiology. As such, the NOV29 nucleic acids and polypeptides, antibodies and related compounds according to the invention may be used to treat metabolic, immune and renal disorders, e.g., metabolic diseases such as diabetes and hypertension, or cancer, trauma, regeneration (in vitro and in vivo), viral/bacterial/parasitic infections, diabetes, autoimmune disease, renal artery stenosis, interstitial nephritis, glomerulonephritis, polycystic kidney disease, systemic lupus erythematosus, renal tubular acidosis, IgA nephropathy, hypercalceimia, Lesch-Nyhan syndrome, cirrhosis, transplantation, or infertility. The NOV29 nucleic acids and polypeptides are useful for detecting specific cell types. For example, expression analysis has demonstrated that a NOV29 nucleic acid is expressed in Kidney, Liver, Testis, Whole Organism.

Additional utilities for NOV29 nucleic acids and polypeptides according to the invention are disclosed herein.

NOV30

A NOV30 polypeptide has been identified as a Sodium-glucose cotransporter (SGLT)-like protein (also referred to as CG56398-01). The disclosed novel NOV30 nucleic acid (SEQ ID NO:116) of 2105 nucleotides is shown in Table 30A. The novel NOV30 nucleic acid sequences maps to the chromosome 16.

An ORF begins with a Kozak consensus ATG initiation codon at nucleotides 31–33 and ends with a TAA codon at nucleotides 2056–2058. A putative untranslated region and/ or downstream from the termination codon is underlined in Table 30A, and the start and stop codons are in bold letters.

TABLE 30A

NOV30 Nucleotide Sequence (SEQ ID NO: 116)

CCTCAGGATCCAGAGGTCTCGTTCAGGACCATGGAGAGCGGCACCAGCAGCCCTCAGCCTCCACAGT
TAGATCCCCTGGATGCGTTTCCCCAGAAGGGCTTGGAGCCTGGGGACATCGCGGTGCTAGTTCTGTA
CTTCCTCTTTGTCCTGGCTGTTGGACTATGGTCCACAGTGAAGACCAAAAGAGACAGAGTGAAAGGC
TACTTCCTGGCTGGAGGGGACATGGTGTGGTGGCCAGTGGGTGCATCCTTGTTTGCCAGCAATGTTG
GAAGTGGACATTTCATTGGCCTGGCAGGGTCAGGTGCTGCTACGGGCATTTCTGTATCAGCTTATGA

TABLE 30A-continued

NOV30 Nucleotide Sequence (SEQ ID NO: 116)

ACTTAATGGCTTGTTTTCTGTGCTGATGTTGGCCTGGATCTTCCTACCCATCTACATTGCTGGTCAG
GTGACCACGATGCCAGAATACCTACGGAAGCGCTTCGGTGGCATCAGAATCCCCATCATCCTGGCTG
TACTCTACCTATTTATCTACATCTTCACCAAGATCTCGGTAGACATGTATGCAGGTGCCATCTTCAT
CCAGCAGTCTTTGCACCTGGATCTGTACCTGGCCATAGTTGGGCTACTGGCCATCACTGCTGTATAC
ACGGTTGCTGGTGGCCTGGCTGCTGTGATCTACACGGATGCCCTGCAGACGCTGATCATGCTTATAG
GAGCGCTCACCTTGATGGGCTACAGTTTCGCCGCGGTTGGTGGGATGGAAGGACTGAAGGAGAAGTA
CTTCTTGGCCCTGGCTAGCAACCGGAGTGAGAACAGCAGCTGCGGGCTGCCCCGGGAAGATGCCTTC
CATATTTTCCGAGATCCGCTGACATCTGATCTCCCGTGGCCGGGGGTCCTATTTGGAATGTCCATCC
CATCCCTCTGGTACTGGTGCACGGATCAGGTAATTGTCCAGCGGACTCTGGCTGCCAAGAACCTGTC
CCATGCCAAAGGAGGTGCTCTGATGGCTGCATACCTGAAGGTGCTGCCCCTCTTCATAATGGTGTTC
CCTGGGATGGTCAGCCGCATCCTCTTCCCAGATCAAGTGGCCTGTGCAGATCCAGAGATCTGCCAGA
AGATCTGCAGCAACCCCTCAGGCTGTTCGGACATCGCGTATCCCAAACTCGTGCTGGAACTCCTGCC
CACAGGTCTCCGTGGGCTGATGATGGCTGTGATGGTGGCGGCTCTCATGTCCTCCCTCACCTCCATC
TTTAACAGTGCCAGCACCATCTTCACCATGGACCTCTGGAATCACCTCCGGCCTCGGGCATCTGAGA
AGGAGCTCATGATTGTGGGCAGGGTGTTTGTGCTGCTGCTGGTCCTGGTCTCCATCCTCTGGATCCC
TGTGGTCCAGGCCAGCCAGGGCGGCCAGCTCTTCATCTATATCCAGTCCATCAGCTCCTACCTGCAG
CCGCCTGTGGCGGTGGTCTTCATCATGGGATGTTTCTGGAAGAGGACCAATGAAAAGGGTGCCTTCT
GGGGCCTGATCTCGGGCCTGCTCCTGGGCTTGGTTAGGCTGGTCCTGGACTTTATTTACGTGCAGCC
TCGATGCGACCAGCCAGATGAGCGCCCGGTCCTGGTGAAGAGCATTCACTACCTCTACTTCTCCATG
ATCCTGTCCACGGTCACCCTCATCACTGTCTCCACCGTGAGCTGGTTCACAGAGCCACCCTCCAAGG
AGATGGTCAGCCACCTGACCTGGTTTACTCGTCACGACCCCGTGGTCCAGAAGGAACAAGCACCACC
AGCAGCTCCCTTGTCTCTTACCCTCTCTCAGAACGGGATGCCAGAGGCCAGCAGCAGCAGCAGCGTC
GACTTCGAGATGGTTCAAGAAAACACGTCTAAAACCCACAGCGGTGACATGACCCCAAAGCAGTCCA
AAGTGGTGAAGGCCATCCTGTGGCTCTGTGGAATACAGGAGAAGGGCAAGGAAGAGCTCCCGGCCAG
AGCAGAAGCCATCATAGTTTCCCTGGAAGAAAACCCCTTGGTGAAGACCCTCCTGGACGTCAACCTC
ATTTTCTGCGTGAGCTGCGCCATCTTTATCTGGGGCTATTTTGCTTAGTGTGGGGTGAACCCAGGGG
TCCAAACTCTGTTTCTCTTCAGTGCTCC

The NOV30 protein (SEQ ID NO:117) encoded by SEQ ID NO:116 is 675 amino acid residues in length and is presented using the one-letter amino acid code in Table 30B. Psort analysis predicts the NOV30 protein of the invention to be localized to the plasma membrane with a certainty of 0.8000. The Signal P predicts a likely cleavage site for a NOV30 peptide is between positions 50 and 51, i.e., at the dash in the sequence VKT-KR.

TABLE 30B

Encoded NOV30 protein sequence (SEQ ID NO: 117)

MESGTSSPQPPQLDPLDAFPQKGLEPGDIAVLVLYFLFVLAVGLWSTVKTKRDTVKGYFLAGGDM
VWWPVGASLFASNVGSGHFIGLAGSGAATGISVSAYELNGLFSVLMLAWIFLPIYIAGQVTTMPE
YLRKRFGGIRIPIILAVLYLFIYIFTKISVDMYAGAIFIQQSLHLDLYLAIVGLLAITAVYTVAG
GLAAVIYTDALQTLIMLIGALTLMGYSFAAVGGMEGLKEKYFLALASNRSENSSCGLPREDAFHI
FRDPLTSDLPWPGVLFGMSIPSLWYWCTDQVIVQRTLAAKNLSHAKGGALMAAYLKVLPLFIMVF
PGMVSRILFPDQVACADPEICQKICSNPSGCSDIAYPKLVLELLPTGLRGLMMAVMVAALMSSLT
SIFNSASTIFTMDLWNHLRPRASEKELMIVGRVFVLLLVLVSILWIPVVQASQGGQLFIYIQSIS
SYLQPPVAVVFIMGCFWKRTNEKGAFWGLISGLLLGLVRLVLDFIYVQPRCDQPDERPVLVKSIH
YLYFSMILSTVTLITVSTVSWFTEPPSKEMVSHLTWFTRHDPVVQKEQAPPAAPLSLTLSQNGMP
EASSSSSVQFEMVQENTSKTHSGDMTPKQSKVVKAILWLCGIQEKGKEELPARAEAIIVSLEENP
LVKTLLDVNLIFCVSCAIFIWGYFA

A search against the Patp database, a proprietary database that contains sequences published in patents and patent publications, yielded several homologous proteins shown in Table 30C.

TABLE 30C

Patp results for NOV30

| Sequences producing High-scoring Segment Pairs: | Reading Frame | High Score | Smallest Sum Prob P (N) |
|---|---|---|---|
| >patp: AAB60093 Human transport protein TPPT-13 | +1 | 3461 | 0.0 |
| >patp: AAB85102 Novel human transporter protein (NHP) | +1 | 3455 | 0.0 |
| >patp: AAR73595 Cotransporter protein SGLT1 | +1 | 1729 | 2.1e-184 |
| >patp: AAR73593 Cotransporter protein SNST1 | +1 | 1726 | 1.6e-177 |
| >patp: AAY31221 Human SAAT1 protein | +1 | 1629 | 2.9e-174 |

In a BLAST search of public sequence databases, it was found, for example, that the NOV30 nucleic acid sequence of this invention has 1764 of 2068 bases (85%) identical to a gb:GENBANK-ID:RABSGCTP|acc:D16226.1 mRNA from *Oryctolagus cuniculus* (Rabbit mRNA for sodium-glucose cotransporter, complete cds). NOV30 polypeptide was found to have 568 of 675 amino acid residues (84%) identical to, and 624 of 675 amino acid residues (92%) similar to, the 674 amino acid residue ptnr:SPTREMBL-ACC:Q28728 protein from *Oryctolagus cuniculus* (ONE OF THE MEMBERS OF SODIUM-GLUCOSE COTRANSPORTER FAMILY).

NOV30 also has homology to the proteins shown in the BLASTP data in Table 30D.

TABLE 30D

BLAST results for NOV30

| Gene Index/Identifier | Protein/Organism | Length (aa) | Identity (%) | Positives (%) | Expect |
|---|---|---|---|---|---|
| gi|17941285|ref|NP_443176.2| (NM_052944) | putative sodium-coupled cotransporter RKST1 [*Homo sapiens*] | 675 | 597/675 (88%) | 597/675 (88%) | 0.0 |
| gi|15419543|gb|AAK97053.1| AF292385_1 (AF292385) | putative sodium-coupled cotransporter RKST1 [*Homo sapiens*] | 675 | 596/675 (88%) | 596/675 (88%) | 0.0 |
| gi|473969|dbj|BAA03753.1| (D16226) | one of the members of sodium-glucose cotransporter family [*Oryctolagus cuniculus*] | 674 | 503/675 (74%) | 550/675 (80%) | 0.0 |
| gi|16165175|ref|XP_056259.1| (XM_056259) | putative sodium-coupled cotransporter RKST1 [*Homo sapiens*] | 548 | 483/548 (88%) | 483/548 (88%) | 0.0 |
| gi|2564063|dbj|BAA22950.1| (AB008225) | Na+-glucose cotransporter type 1 (SGLT-1)-like protein [*Xenopus laevis*] | 673 | 791 bits (2042) | 409/679 (60%) | 0.0 |

A multiple sequence alignment is given in Table 30E, with the NOV30 protein being shown on line 1 in Table 30E in a ClustalW analysis, and comparing the NOV30 protein with the related protein sequences shown in Table 300D. This BLASTP data is displayed graphically in the ClustalW in Table 30E.

Table 30E. ClustalW Analysis of NOV30

1) > NOV30; SEQ ID NO:117
2) > gi|1794128/ putative sodium-coupled cotransporter RKST1 [*Homo sapiens*]; SEQ ID NO:317
3) > gi|1541954/ putative sodium-coupled cotransporter RSTK1 [Homo sapiens]; SEQ ID NO:318
4) > gi|473969|/ member of sodium-glucose cotransporter family [*Oryctolagus cuniculus*]; SEQ ID NO:319
5) > gi|1616517/ putative sodium-coupled cotransporter RKST1 [*Homo sapiens*]; SEQ ID NO:320
6) > gi|2564063/ Na+-glucose cotransporter type 1 (SGLT-1)-like protein [*Xenopus laevis*]; SEQ ID NO:321

10        20        30        40        50

471                                      472

```
               10        20        30        40        50
               ....|....|....|....|....|....|....|....|....|....|
NOV30          MESGTSSPQPPQLDPLDAFPQKGLEPGDIAVLVLYFLFVLAVGLWSTVKT
gi|1794128     MESGTSSPQPPQLDPLDAFPQKGLEPGDIAVLVLYFLFVLAVGLWSTVKT
gi|1541954     MESGTSSPQPPQLDPLDAFPQKGLEPGDIAVLVLYFLFVLTVGLWSTVKT
gi|473969|     MESSTSSPQPPLSDPLDPFPQRSLEPGDIAVLVLYFLFVLAVGLWSTVKT
gi|1616517     -------------------------------------------------
gi|2564063     METSSQSS-PQTTPGMEAFPKKSLDTIDIVVLVLYFVFVLAVGILSMCRT 60        70        80        90       100
               ....|....|....|....|....|....|....|....|....|....|
NOV30          KRDTVKGYFLAGGDMVWWPVGASLFASNVGSGHFIGLAGSGAATGISVSA
gi|1794128     KRDTVKGYFLAGGDMVWWPVGASLFASNVGSGHFIGLAGSGAATGISVSA
gi|1541954     KRDTVKGYFLAGGDMVWWPVGASLFASNVGSGHFIGLAGSGAATGISVSA
gi|473969|     KRDTVKGYFLAGGDMVWWPVGASLFASNVGSGHFVGLAGSGAATGISVAA
gi|1616517     -------------------------------------------------
gi|2564063     KRGTVKGYFLAGKDMAWWPVGASLFASNVGSGHFIGLAGSGAASGIAVTA 110       120       130       140       150
               ....|....|....|....|....|....|....|....|....|....|
NOV30          YELNGLFSVLMLAWIFLPIYIAGQVTTMPEYLRKRFGGIRIPIILAVLYL
gi|1794128     YELNGLFSVLMLAWIFLPIYIAGQVTTMPEYLRKRFGGIRIPIILAVLYL
gi|1541954     YELNGLFSVLMLAWIFLPIYIAGQVTTMPEYLRKRFGGIRIPIILAVLYL
gi|473969|     YEFNGMFSVLMLAWIFLPIYIAGQVTTMPEYLRRRFGCSRIAITLAVLYL
gi|1616517     ------------------------MPEYLRKRFGGIRIPIILAVLYL
gi|2564063     YEWNGLFCVLALAWLFLPIYISAGVTTMPEYLQRRFGGKRIQIFLAILYL 160       170       180       190       200
               ....|....|....|....|....|....|....|....|....|....|
NOV30          FIYIFTKISVDMYAGAIFIQQSLHLDLYLAIVGLLAITAVYTVAGGLAAV
gi|1794128     FIYIFTKISVDMYAGAIFIQQSLHLDLYLAIVGLLAITAVYTVAGGLAAV
gi|1541954     FIYIFTKISVDMYAGAIFIQQSLHLDLYLAIAGLLAITAVYTVAGGLAAV
gi|473969|     FIYIFTKISVDMYTGAIFIQQSLHLDLYLSVVGLLAVTALYTVAGGLAAV
gi|1616517     FIYIFTKISVDMYAGAIFIQQSLHLDLYLAIVGLLAITAVYTVAGGLAAV
gi|2564063     FIYIFTKISVDMYAGALFIQQALQWDLYVAVIGLLVITAIYTVAGGLAAV 210       220       230       240       250
               ....|....|....|....|....|....|....|....|....|....|
NOV30          IYTDALQTLIMLIGALTLMGYSFAAVGGMEGLKEKYFLALASNRSENSSC
gi|1794128     IYTDALQTLIMLIGALTLMGYSFAAVGGMEGLKEKYFLALASNRSENSSC
gi|1541954     IYTDALQTLIMLIGALTLMGYSFAAVGGMEGLKEKYFLALASNRSENSSC
gi|473969|     IYTDALQTLIMLVGALTLMGYSFAAVGGMEGLQEKYFLALPSNRSENSSC
gi|1616517     IYTDALQTLIMLIGALTLMGYSFAAVGGMEGLKEKYFLALASNRSENSSC
gi|2564063     IYTDTLQTVIMIIGALILMAYSFIEIGGFEALQEKYFHAIPNTHSGNSTC 260       270       280       290       300
               ....|....|....|....|....|....|....|....|....|....|
NOV30          GLPREDAFHIFRDPLTSDLPWPGVLFGMSIPSLWYWCTDQVIVQRTLAAK
gi|1794128     GLPREDAFHIFRDPLTSDLPWPGVLFGMSIPSLWYWCTDQVIVQRTLAAK
gi|1541954     GLPREDAFHIFRDPLTSDLPWPGVLFGMSIPSLWYWCTDQVIVQRTLAAK
gi|473969|     GLPREDAFHLFRDPLTSDLPWPGTLFGMSIPSLWYWCTDQVIVQRSLAAK
gi|1616517     GLPREDAFHIFRDPLTSDLPWPGVLFGMSIPSLWYWCTDQVIVQRTLAAK
gi|2564063     GIPREDAFHIFRDPVTSDLPWPGVLVGMTIPSLWYWCTDQVIVQRSLSAK 310       320       330       340       350
               ....|....|....|....|....|....|....|....|....|....|
NOV30          NLSHAKGGALMAAYLKVLPLFIMVFPGMVSRILFPDQVACADPEICQKIC
gi|1794128     NLSHAKGGALMAAYLKVLPLFIMVFPGMVSRILFPDQVACADPEICQKIC
gi|1541954     NLSHAKGGALMAAYLKVLPLFIMVFPGMVSRILFPDQVACADPETCQRVC
gi|473969|     NLSHAKGGSLMAAYLKVLPLFIMVFPGMVSRILFPDQVACADPEICQKIC
gi|1616517     NLSHAKGGALMAAYLKVLPLFIMVFPGMVSRILFPDQVACADPEICQKIC
gi|2564063     NLSHAKAGSLLAASLKVLPLFMMVLPGMISRVLFTDQVACADPELCKEIC 360       370       380       390       400
```

```
NOV30         SNPSGCSDIAYPKLVLELLPTGLRGLMMAVMVAALMSSLTSIFNSASTIF
gi|1794128    SNPSGCSDIAYPKLVLELLPTGLRGLMMAVMVAALMSSLTSIFNSASTIF
gi|1541954    SNPSGCSDIAYPKLVLELLPTGLRGLMMAVMVAALMSSLTSIFNSASTIF
gi|473969|    NNPSGCSDIAYPKLVLELLPTGLRGLMMAVMVAALMSSLTSIFNSASTIF
gi|1616517    SNPSGCSDIAYPKLVLELLPTGLRGLMMAVMVAALMSSLTSIFNSASTIF
gi|2564063    GNPSGCSDIAYPKMVIELLPTGLRGLMMSVMIAALMSSLTSIFNSASTIF 410       420       430       440       450
                  ....|....|....|....|....|....|....|....|....|....|
NOV30         TMDLWNHLRPRASEKELMIVGRVFVLLLVLVSILWIPVVQASQGGQLFIY
gi|1794128    TMDLWNHLRPRASEKELMIVGRVFVLLLVLVSILWIPVVQASQGGQLFIY
gi|1541954    TMDLWNHLRPRASEKELMIVGRVFVLLLVLVSILWIPVVQASQGGQLFIY
gi|473969|    TMDLWNHVRPRASEKELMIVGRVFVLLLVLVSVLWIPVVQASQGGQLFVY
gi|1616517    TMDLWNHLRPRASEKELMIVGRVFVLLLVLVSILWIPVVQASQGGQLFIY
gi|2564063    TMDLWRHIRPRSTEWELMIVGRVFVLVLVVVSILWIPLVQASQGGQLFIY 460       470       480       490       500
                  ....|....|....|....|....|....|....|....|....|....|
NOV30         IQSISSYLQPPVAVVFIMGCFWKRTNEKGAFWGLISGLLLGLVRLVLDFI
gi|1794128    IQSISSYLQPPVAVVFIMGCFWKRTNEKGAFWGLISGLLLGLVRLVLDFI
gi|1541954    IQSISSYLQPPVAVVFIMGCFWKRTNEKGAFWGLISGLLLGLVRLVLDFI
gi|473969|    IQAISSYLQPPVAMVFVLGCFWKRANEKGAFWGLVLGLLLGFIRLILDFI
gi|1616517    IQSISSYLQPPVAVVFIMGCFWKRTNEKGAFWGLISGLLLGLVRLVLDFI
gi|2564063    IQSISSYLQPPVAVVFIAGCFWKRTNEKGAFWGMTIGIVVGLIRMVLDFI 510       520       530       540       550
                  ....|....|....|....|....|....|....|....|....|....|
NOV30         YVQPRCDQPDERPVLVKSIHYLYFSMILSTVTLITVSTVSWFTEPPSKEM
gi|1794128    YVQPRCDQPDERPVLVKSIHYLYFSMILSTVTLITVSTVSWFTEPPSKEM
gi|1541954    YVQPRCDQPDERPVLVKSIHYLYFSMILSTVTLITVSTVSWFTEPPSKEM
gi|473969|    YVEPACHQPDERPSVVKNVHYLYFSMILSSVTVLTVTVMSLLTEPPSKEM
gi|1616517    YVQPRCDQPDERPVLVKSIHYLYFSMILSTVTLITVSTVSWFTEPPSKEM
gi|2564063    YVAPQCDQPDTRPGVVKYVHYLYSMILGLLTLLVVVAVSLWTEPPSKQM 560       570       580       590       600
                  ....|....|....|....|....|....|....|....|....|....|
NOV30         VSHLTWFTRHDPVVQKEQAPPAAPLSLTLSQNGMPEASSSSSVQFEMVQE
gi|1794128    VSHLTWFTRHDPVVQKEQAPPAAPLSLTLSQNGMPEASSSSSVQFEMVQE
gi|1541954    VSHLTWFTRHDPVVQKEQAPPAAPLSLTLSQNGMPEASSSSSVQFEMVQE
gi|473969|    ISHLTWFTRRDPVVQKAQVPAATPLPPALSHNGTAEAN-SASIQLETIQE
gi|1616517    VSHLTWFTRHDPVVQKEQAPPAAPLSLTLSQNGMPEASSSSSVQFEMVQE
gi|2564063    ISRLTWFTRFDAEVEDPVETNHRP-----AENGISVVEDISEEPHTTSTD 610       620       630       640       650
                  ....|....|....|....|....|....|....|....|....|....|
NOV30         NTSKTHSGDMTPKQSKVVKAILWLCGIQ----EKGKEELPARAEAIIVSL
gi|1794128    NTSKTHSCDMTPKQSKVVKAILWLCGIQ----EKGKEELPARAEAIIVSL
gi|1541954    NTSKTHSCDMTPKQSKVVKAILWLCGIQ----EKGKEELPARAEAIIVSL
gi|473969|    GASKAHSSDVTPKQSRVVRALLWLCGME----GKSTEQARPRAEPVLASI
gi|1616517    NTSKTHSCDMTPKQSKVVKAILWLCGIQ----EKGKEELPARAEAIIVSL
gi|2564063    AIYNDTTDDNPSSSSLLKKTILWLCGMDSRKGDKHDQAPPAPLEPAEVLL 660       670
                  ....|....|....|....|....|....
NOV30         EENPLVKTLLDVNLIFCVSCAIFIWGYFA
gi|1794128    EENPLVKTLLDVNLIFCVSCAIFIWGYFA
gi|1541954    EENPLVKTLLDVNLIFCVSCAIFIWGYFA
gi|473969|    EENPVVKTLLDVNCLLCICCAFFLWGYFA
gi|1616517    EENPLVKTLLDVNLIFCVSCAIFIWGYFA
gi|2564063    YERPLLKQVLNTAVILCMSAGVFLWAYFG
```

The presence of identifiable domains in the protein disclosed herein was determined by searches using algorithms such as PROSITE, Blocks, Pfam, ProDomain, Prints and then determining the Interpro number by crossing the domain match (or numbers) using the Interpro website (http:www.ebi.ac.uk/interpro/). Table 30F lists the domain description from DOMAIN analysis results against NOV30.

TABLE 30F

Domain Analysis of NOV30

| Model | Region of Homology | Score (bits) | E value |
|---|---|---|---|
| Sodium:solute symporter family | 58–487 | 676.0 | 1e-200 |
| Phosphotransferase system, EIIC | 29–277 | −161.4 | 0.88 |
| Amino acid permease | 71–474 | −358.2 | 0.97 |
| 60 Kd inner membrane protein | 106–234 | −136.8 | 0.78 |

Consistent with other known members of the sodium: solute symporter family (SSF), the NOV30 Na+/glucose transporter-like protein contains the sodium:solute symporter family domain and an integral membrane domain as illustrated in Table 30F (Ohashi and Erickson, J. Biol. Chem., 272: 14220–6(1997)). NOV30 nucleic acids, and the encoded polypeptides, according to the invention are useful in a variety of applications and contexts. For example, NOV30 nucleic acids and polypeptides can be used to identify proteins that are members of the sodium:solute symporter family of proteins. The NOV30 nucleic acids and polypeptides can also be used to screen for molecules, which inhibit or enhance NOV30 activity or function.

Specifically, the nucleic acids and polypeptides according to the invention may be used as targets for the identification of small molecules that modulate or inhibit, e.g., cellular activation and cellular metabolism. These molecules can be used to treat, e.g., for metabolic diseases such as cancer, trauma, regeneration (in vitro and in vivo), viral/bacterial/parasitic infections, hyperparathyroidism, hypoparathyroidism, inflammatory bowel disease, diverticular disease, Von Hippel-Lindau (VHL) syndrome, Alzheimer's disease, stroke, tuberous sclerosis, hypercalceimia, Parkinson's disease, Huntington's disease, cerebral palsy, epilepsy, Lesch-Nyhan syndrome, multiple sclerosis, ataxia-telangiectasia, leukodystrophies, behavioral disorders, addiction, anxiety, pain, neurodegeneration, systemic lupus erythematosus, autoimmune disease, asthma, emphysema, scleroderma, allergy, ARDS, diabetes, autoimmune disease, renal artery stenosis, interstitial nephritis, glomerulonephritis, polycystic kidney disease, systemic lupus erythematosus, renal tubular acidosis, IgA nephropathy, hypercalceimia, inflammatory bowel disease, diverticular disease and other diseases, disorders and conditions of the like.

In addition, various NOV30 nucleic acids and polypeptides according to the invention are useful, inter alia, as novel members of the protein families according to the presence of domains and sequence relatedness to previously described proteins. For example, the NOV30 nucleic acids and their encoded polypeptides include structural motifs that are characteristic of proteins belonging to the SSF family such as the Na+/glucose transporter proteins involved in renal transport and metabolism. (Ohashi and Erickson, J. Biol. Chem., 272: 14220–6(1997)).

Integral membrane proteins that mediate the intake of a wide variety of molecules with the concomitant uptake of sodium ions are grouped into a number of distinct families. One of these families, known as the SSF, consists of integral membrane proteins that are predicted to comprise at least ten membrane spanning domains. Members of the SSF catalyze solute:Na+ symport (Reizer et al.,. Biochem. Biophys. Acta, 1197: 133–166(1994)) can transport sugars, amino acids, nucleosides, inositols, vitamins, urea or anions, depending on the system. Members of the SSF family have been identified in bacteria, archaea and animals, and all functionally well characterized members catalyze solute uptake via Na+ symport.

The NOV30 nucleic acids and polypeptides, antibodies and related compounds according to the invention will be useful in therapeutic and diagnostic applications in the mediation of metabolism and immune function and renal physiology. As such, the NOV30 nucleic acids and polypeptides, antibodies and related compounds according to the invention may be used to treat metabolic, immune and renal disorders, e.g., metabolic diseases such as diabetes and hypertension, cancer, trauma, regeneration (in vitro and in vivo), viral/bacterial/parasitic infections, hyperparathyroidism, hypoparathyroidism, inflammatory bowel disease, diverticular disease, Von Hippel-Lindau (VHL) syndrome, Alzheimer's disease, stroke, tuberous sclerosis, hypercalceimia, Parkinson's disease, Huntington's disease, cerebral palsy, epilepsy, Lesch-Nyhan syndrome, multiple sclerosis, ataxia-telangiectasia, leukodystrophies, behavioral disorders, addiction, anxiety, pain, neurodegeneration, systemic lupus erythematosus, autoimmune disease, asthma, emphysema, scleroderma, allergy, ARDS, diabetes, autoimmune disease, renal artery stenosis, interstitial nephritis, glomerulonephritis, polycystic kidney disease, systemic lupus erythematosus, renal tubular acidosis, IgA nephropathy, hypercalceimia, inflammatory bowel disease, diverticular disease and other diseases, disorders and conditions of the like. For example, expression analysis has demonstrated that a NOV30 nucleic acid is expressed in Kidney, Parathyroid, Brain, Hippocampus, Hypothalamus, Lung, Small Intestine, Spinal Chord, Substantia Nigra, Whole Organism.

Additional utilities for NOV30 nucleic acids and polypeptides according to the invention are disclosed herein.

NOV31

A NOV31 polypeptide has been identified as a Olfactory Receptor (GPCR)-like protein (also referred to as CG56616-01). The disclosed novel NOV31 nucleic acid (SEQ ID NO:118) of 1201 nucleotides is shown in Table 31A. An ORF begins with Kozak consensus ATG initiation codon at nucleotides 86–88 and ends with a TAA codon at nucleotides 1040–1042. A putative untranslated region and/or downstream from the termination codon is underlined in Table 31A, and the start and stop codons are in bold letters.

TABLE 31A

NOV31 Nucleotide Sequence (SEQ ID NO: 118)

TCATTGACACATGCTTGAAAGTAATCAGAGTAAGATAAATATTTGTCTTAACATGCTCTGTCTTACA
AGCTAAAGAGGGAGTAAAATGGAATGGGAAAACCACACCATTCTGGTGGAATTTTTTCTGAAGGGAC
TTTCTGGTCACCCAAGACTTGAGTTACTCTTTTTTGTGCTCATCTTCATAATGTATGTGGTCATCCT
TCTGGGGAATGGTACTCTCATTTTAATCAGCATCTTGGACCCTCACCTTCACACCCCTATGTACTTC
TTTCTGGGGAACCTCTCCTTCTTGGACATCTGCTACACCACCACCTCTATTCCCTCCACGCTAGTGA
GCTTCCTTTCAGAAAGAAAGACCATTTCCCTTTCTGGCTGTGCAGTGCAGATGTTCCTCAGCTTGGC
CATGGGGACAACAGAGTGTGTGCTTCTGGGCGTGATGGCCTTTGACCGCTATGTGGCTATCTGCAAC
CCTCTGAGATATCCCATCATCATGAGTAAGGATGCCTATGTACCCATGGCAGCTGGGTCCTGGATCA
TAGGAGCTGTCAATTCTGCAGTACAAACAGTGTTTGTGGTACAATTGCCTTTCTGCAGGAATAACAT
CATCAATCATTTCACCTGTGAAATTCTAGCTGTCATGAAACTGGCCTGTGCTGACATCTCAGGCAAT
GAGTTCATCCTGCTTGTGACCACAACATTGTTCCTATTGACACCTTTGTTATTAATTATTGTCTCTT
ACACGTTAATCATTTTGAGCATCTTCAAAATTAGCTCTTCGGAGGGGAGAAGCAAACCTTCCTCTAC
CTGCTCAGCTCGTCTGACTGTGGTGATAACATTCTGTGGGACCATCTTCCTCATGTACATGAAGCCC
AAGTCTCAAGAGACACTTAATTCAGATGACTTGGATGCCACTGACAAACTTATATTCATATTCTACA
GGGTGATGACTCCCATGATGAATCCTTTAATCTACAGTCTTAGAAACAAGGATGTGAAGGAGGCAGT
AAAACACCTACTGAGAAGAAAAAATTTTAACAAGTAAATGAGAAAGGTGAGAGTAATTTTATAATCA
CAATATGGAAATCAATTAGAGAAACCAAGGTTAAACAGATAGGTTCTCGTTGCTGTTTCACATTCAT
CTCTCGAAGTTCTAAAGCTCCAAAATACACTTCTCTGATTGCGATACATAATGAAAAGAAGT

The NOV31 protein (SEQ ID NO:119) encoded by SEQ ID NO:118 is 318 amino acid residues in length and is presented using the one-letter amino acid code in Table 31B. NOV31 has at least 10 SNP variants, whose variant positions for its nucleotide and amino acid sequences is numbered according to SEQ ID NOS:118 and 119, respectively. A variant sequence can include a single nucleotide polymorphism (SNP). A SNP can, in some instances, be referred to as a "cSNP" to denote that the nucleotide sequence containing the SNP originates as a cDNA. Variant sequences of NOV31 are included in Example 2.

Psort analysis predicts the NOV31 protein of the invention to be localized to the plasma membrane with a certainty of 0.6000. The Signal P predicts a likely cleavage site for a NOV29b peptide is between positions 41 and 42, i.e., at the dash in the sequence LLG-NG.

TABLE 31B

Encoded NOV31 protein sequence (SEQ ID NO: 119)

MEWENHTILVEFFLKGLSGHPRLELLFFVLIFIMYVVILLGNGTLILISILDPHLHTPMYFFLGN
LSFLDICYTTTSIPSTLVSFLSERKTISLSGCAVQMFLSLAMGTTECVLLGVMAFDRYVAICNPL
RYPIIMSKDAYVPMAAGSWIIGAVNSAVQTVFVVQLPFCRNNIINHFTCEILAVMKLACADISGN
EFILLVTTTLFLLTPLLLIIVSYTLIILSIFKISSSEGRSKPSSTCSARLTVVITFCGTIFLMYM
KPKSQETLNSDDLDATDKLIFIFYRVMTPMMNPLIYSLRNKDVKEAVKHLLRRKNFNK

A search against the Patp database, a proprietary database that contains sequences published in patents and patent publications, yielded several homologous proteins shown in Table 31C.

TABLE 31C

Patp results for NOV31

| Sequences producing High-scoring Segment Pairs: | Reading Frame | High Score | Smallest Sum Prob P (N) |
|---|---|---|---|
| >patp: AAG71953 Human olfactory receptor polypeptide | +1 | 1620 | 2.7e–166 |

TABLE 31C-continued

Patp results for NOV31

| Sequences producing High-scoring Segment Pairs: | Reading Frame | High Score | Smallest Sum Prob P (N) |
|---|---|---|---|
| >patp: AAU24703 Human olfactory receptor AOLFR202 | +1 | 1620 | 2.7e–166 |
| >patp: AAG71431 Human olfactory receptor polypeptide | +1 | 1504 | 5.2e–154 |
| >patp: AAU24702 Human olfactory receptor AOLFR201 | +1 | 1504 | 5.2e–154 |
| >patp: AAG72024 Human olfactory receptor polypeptide | +1 | 1399 | 7.0e–143 |

In a BLAST search of public sequence databases, it was found, for example, that the NOV31 nucleic acid sequence of this invention has 702 of 991 bases (70%) identical to a gb:GENBANK-ID:MMU133426|acc:AJ133426.1 mRNA from *Mus musculus* (or 37c gene). The full amino acid sequence of the protein of the invention was found to have 209 of 314 amino acid residues (66%) identical to, and 246 of 314 amino acid residues (78%) similar to, the 318 amino acid residue ptnr:SPTREMBL-ACC:Q9QZ21 protein from *Mus musculus* (OLFACTORY RECEPTOR). Also 100% similarity to Genbank_AL450426.3 sequence that is not annotated.

NOV31 also has homology to the proteins shown in the BLASTP data in Table 31D.

TABLE 31D

BLAST results for NOV31

| Gene Index/Identifier | Protein/Organism | Length (aa) | Identity (%) | Positives (%) | Expect |
|---|---|---|---|---|---|
| gi|17452276|ref|XP_071094.1| (XM_071094) | similar to olfactory receptor 37b [Homo sapiens] | 318 | 291/318 (91%) | 291/318 (91%) | 1e-150 |
| gi|17452271|ref|XP_071093.1| (XM_071093) | similar to olfactory receptor 37b [Homo sapiens] | 318 | 272/318 (85%) | 279/318 (87%) | 1e-137 |
| gi|17452269|ref|XP_071092.1| (XM_071092) | similar to olfactory receptor 37b [Homo sapiens] | 318 | 255/318 (80%) | 268/318 (84%) | 1e-127 |
| gi|11276077|ref|NP_062347.1| (NM_019474) | olfactory receptor 37b [Mus musculus] | 318 | 200/314 (63%) | 230/314 (72%) | 1e-101 |
| gi|11276079|ref|NP_062348.1| (NM_019475) | olfactory receptor 37c [Mus musculus] | 318 | 198/310 (63%) | 224/310 (71%) | 8e-99 |

A multiple sequence alignment is given in Table 31 E, with the NOV31 protein being shown on line 1 in Table 31E in a ClustalW analysis, and comparing the NOV31 protein with the related protein sequences shown in Table 31D. This BLASTP data is displayed graphically in the ClustalW in Table 31E.

Table 31E. ClustalW Analysis of NOV31

1) > NOV31; SEQ ID NO:119
2) > gi|1745227/ similar to Olfactory receptor 37b [*Homo sapiens*] ; SEQ ID NO:322
3) > gi|1745227/ similar to olfactory receptor 37b [*Homo sapiens*] ; SEQ ID NO:323
4) > gi|1745226/ similar to olfactory receptor 37b [*Homo sapiens*] ; SEQ ID NO:324
5) > gi|1127607/ olfactory receptor 37b [*Mus musculus*] ; SEQ ID NO:325
6) > gi|1127607/ olfactory receptor 37c [*Mus musculus*] ; SEQ ID NO:326

```
                    10         20         30         40         50
              ....|....|....|....|....|....|....|....|....|....|
NOV31         MEWENHTILVEFFLKGLSGHPRLELLFFVLIFIMYVVILLGNGTLILISI
gi|1745227    MEWENHTILVEFFLKGLSGHPRLELLFFVLIFIMYVVILLGNGTLILISI
gi|1745227    MEWENHTILVEFFLKGLSGHPRLELLFFVLIFIMYVVILLGNGTLILISI
gi|1745226    MEWENQTILVEFFLKGHSVHPRLELLFFVLIFIMYVVILLGNGTLILISI
gi|1127607    MEGANQSTVAEFVLLGLSDHPKLEKTFFVLILLMYLVILLGNGVLILVSI
gi|1127607    MDVSNQTTVTEFVLLGLSAHPKLEKTFFVLILSMYLVILLGNGVLILVSI 60         70         80         90        100
              ....|....|....|....|....|....|....|....|....|....|
NOV31         LDPHLHTPMYFFLGNLSFLDICYTTTSIPSTLVSFLSERKTISLSGCAVQ
gi|1745227    LDPHLHTPMYFFLGNLSFLDICYTTTSIPSTLVSFLSERKTISLSGCAVQ
gi|1745227    LDPHLHTPMYFFLGNLSFLDICYTTTSIPSTLVSFLSERKTISLSGCAVQ
gi|1745226    LDPHLHTPMYFFLGNLSFLDICYTTTSIPSTLVSFLSERKTISFSGCAVQ
gi|1127607    LDSHLHTPMYFFLGDLSFLDICYTTSSIPLVLDGFLTPRKTISFSGCAVQ
gi|1127607    LDSHLHTPMYFFLGNLSFLDICYTTSSVPLVLDGFLTPRKTISFSGCAVQ
```

483  484

```
                   110        120        130        140        150
                ....|....|....|....|....|....|....|....|....|....|
NOV31           MFLSLAMGTTECVLLGVMAFDRYVAICNPLRYPIIMSKDAYVPMAAGSWI
gi|1745227      MFLSLAMGTTECVLLGVMAFDRYVAICNPLRYPIIMSKDAYVPMAAGSWI
gi|1745227      MFLGLAMGTTECVLLGMMAFDRYVAICNPLRYPIIMSKDAYVPMAAGSWI
gi|1745226      MFLGLAMGTTECVLLGMMAFDRYVAICNPLRYPIIMSKNAYVPMAVGSWF
gi|1127607      MFLSFAMGATECVLLGMMAFDRYVAICNPLRYPVVMNKSAYVPMAVSSWV
gi|1127607      MFLSFAMGATECVLLGMMAFDRYVAICNPLRYPVVMNKAAYVPMAVSSWV 160        170        180        190        200
                ....|....|....|....|....|....|....|....|....|....|
NOV31           IGAVNSAVQTVFVVQLPFCRNNIINHFTCEILAVMKLACADISGNEFILL
gi|1745227      IGAVNSAVQTVFVVQLPFCRNNIINHFTCEILAVMKLACADISGNEFILL
gi|1745227      IGAVNSAVQSVFVVQLPFCRNNIINHFTCEILAVMKLACADISDNEFIML
gi|1745226      AGIVNSAVQTTFVVQLPFCRKNVINHFSCEILAVMKLACADISGNEFLML
gi|1127607      AGGANSLVQISLAVQLPFCGDNVINHFTCEILAVLKLACADISINVISMG
gi|1127607      AGGANSLVQISLAVQLPFCGDNVINHFICEILAVLKLACADISINVISMG 210        220        230        240        250
                ....|....|....|....|....|....|....|....|....|....|
NOV31           VTTTLFLLTPLLLIVSYTLIILSIFKISSSEGRSKPSSTCSARLTVVIT
gi|1745227      VTTTLFLLTPLLLIVSYTLIILSIFKISSSEGRSKPSSTCSARLTVVIT
gi|1745227      VATTLFILTPLLLIVSYTLIIVSIFKISSSEGRSKASSTCSAHLTVVII
gi|1745226      VATILFTIMPLLLIVSYSLIISSILKIHSSEGRSKAFSTCSAHLTVVII
gi|1127607      VANVIFLGVPVLFIFVSYIFILSTILRIPSAEGRKKAFSTCSAHLTVVLV
gi|1127607      VANVIFLGVPVLFIFVSYIFILSTILRIPSAEGRKKAFSTCSAHLTVVII 260        270        280        290        300
                ....|....|....|....|....|....|....|....|....|....|
NOV31           FCGTIFLMYMKPKSQETLNSDDLDATDKLIFIFYRVMTPMMNPLIYSLRN
gi|1745227      FCGTIFLMYMKPKSQETLNSDDLDATDKLIFIFYRVMTPMMNPLIYSLRN
gi|1745227      FYGTILFMYMKPKSKETLNSDDLDATDKIISMFYGVMTPMMNPLIYSLRN
gi|1745226      FYGTILFMYMKPKSKETLNSDDLDATDKIISMFYGVMTPMMNPLIYSLRN
gi|1127607      FYGTILFMYGKPKSKDPLGADKQDVSDKLISLFYGVLTPMLNPIIYSLRN
gi|1127607      FYGTILFMYGKPKSKDPLGADKQDLADKLISLFYGLLTPMLNPIIYSLRN

310
                ....|....|....|...
NOV31           KDVKEAVKHLLRRKNFNK
gi|1745227      KDVKEAVKHLLRRKNFNK
gi|1745227      KDVKEAVKHLLNRRFFSK
gi|1745226      KDVKEAVKHLPNRRFFSK
gi|1127607      KDVKAAVRNLVGQKCLIQ
gi|1127607      KDVKAAVRNLASHRCLTF
```

The presence of identifiable domains in the protein disclosed herein was determined by searches using algorithms such as PROSITE, Blocks, Pfam, ProDomain, Prints and then determining the Interpro number by crossing the domain match (or numbers) using the Interpro website (http:www.ebi.ac.uk/interpro/). The DOMAIN analysis results indicate that the NOV31 protein contains the following protein domain (as defined by Interpro): domain name 7tm_1 7 transmembrane receptor (rhodopsin family). DOMAIN results for NOV31 were collected from the Conserved Domain Database (CDD) with Reverse Position Specific BLAST. This BLAST samples domains found in the Smart and Pfam collections.

As discussed below, the NOV31 protein of the invention contained significant homology to the 7tm_1 domain. This indicates that the NOV31 sequence has properties similar to those of other proteins known to contain this 7tm_1 domain and similar to the properties of these domains. The 254 amino acid domain termed 7tm_1 (SEQ ID NO:327; Pfam Acc. No. 00001) a seven transmembrane receptor (rhodopsin family), is shown in Table 31F.

TABLE 31F

| 7tm_1, 7 transmembrane receptor domain (SEQ ID NO: 327) |
| --- |
| GNLLVILVILRTKKLRTPTNIFLLNLAVADLLFLLTLPPWALYYLVGGDWVFGDALCKLVGALFVVNGYASILLLTAISIDRYL AIVHPLRYRRIRTPRRAKVLILLVWVLALLLSLPPLLFSWLRTVEEGNTTVCLIDFPEESVKRSYVLLSTLVGFVLPLLVILVC YTRILRTLRKRARSQRSLKRRSSSERKAAKMLLVVVVVFVLCWLPYHIVLLLDSLCLLSIWRVLPTALLITLWLAYVNSCLNPI IY |

The DOMAIN results are listed in Table 31 G with the statistics and domain description. An alignment of NOV31 residues 41–296 (SEQ ID NO:119) with the full 7tm_1 domain, residues 1–254 (SEQ ID NO:327), are shown in Table 31G. This indicates that the NOV31 sequences have properties similar to those of other proteins known to contain this domain as well as to the 254 amino acid 7tm domain (SEQ ID NO:327). For Table 31G, fully conserved single residues are indicated by the vertical line and "strong" semi-conserved residues are indicated by the "plus sign." The "strong" group of conserved amino acid residues may be any one of the following groups of amino acids: STA, NEQK, NHQK, NDEQ, QHRK, MILV, MILF, HY, FYW.

TABLE 31G

Domain Analysis of NOV31

```
                                                                                Score     E
PSSMs producing significant alignments:                                         (bits)    value gnl|Pfam|pfam00001 7tm_1, 7 transmembrane receptor (rhodopsin family)           128.7     7.9e-40

*->GNlLVilvilrtkklrtptnifilNLAvADLLflltlppwalyylvg
                  ||+   ||+ ++  +|+||+++|++||++ |+++++|   |  +|+ ++
     NOV31    41  GNGTLILISILDPHLHTPMYFFLGNLSFLDICYTTTSIPSTLVSFLS  87 gsedWpfGsalCklvtaldvvnmyaSillLtaISiDRYlAIvhPlryrrr
               |++ ++  +|  ++++|  ++ +++ + ||  ++++|||+||++|||+ +
     NOV31    88  --ERKTISLSGCAVQMFLSLAMGTTECVLLGVMAFDRYVAICNPLRYPII 135 rtsprrAkvvillvWvlalllslPpllfswvktveegngtlnvnvtvCli
               ++ +   + + ++ |+++++ |   + +|   |++++++|+    +|+++|  |
     NOV31   136  MS-KDAYVPMAAGSWIIGAVNSAVQTVF-VVQLPFCRNNI--INHFTCEI 181 dfpeestas.vstwlrsyvllstlvgFllPllvilvcYtrIlrtlr....
                 +    ++ +  |    +++ |+ |+++  |  |||+|+|  ||+|+  +++ ++
     NOV31   182  LAVMKLACAdISGN-EFILLVTTTLFLLTPLLLIIVSYTLIILSIFkiss 230

........kaaktllvvvvvFvlCWlPyfivllldtlc.lsiimsstCel
               ++++++++ ++   |+||++|+        +++|++ ++ |   +  |   +
     NOV31   231  segrskpssSTCSARLTVVITFC-------GTIFLMYMKpKS---QETLNS 270 ervlptallvtlwLayvNsclNPiIY<-*       (SEQ ID NO:327)
               ++   |  +|+++++ +  +++||+||
     NOV31   271  DDLDATDKLIFIFYRVMTPMMNPLIY     296  (SEQ ID NO:119)
```

Consistent with other known members of the GPCR family of proteins, NOV31 contains 7tm_1 7 transmembrane receptor (rhodopsin family) domain as illustrated in Table 31G as well as homology and cellular localization, i.e. plasma membrane.

NOV31 nucleic acids, and the encoded polypeptides, according to the invention are useful in a variety of applications and contexts. For example, NOV31 nucleic acids and polypeptides can be used to identify proteins that are members of the GPCR family of proteins. The NOV31 nucleic acids and polypeptides can also be used to screen for molecules, which inhibit or enhance NOV31 activity or function. Specifically, the nucleic acids and polypeptides according to the invention may be used as targets for the identification of small molecules that modulate or inhibit, e.g., cellular signal transduction. These molecules can be used to treat, e.g., cancer, immune disorders, and endocrine disorders.

In addition, various NOV31 nucleic acids and polypeptides according to the invention are useful, inter alia, as novel members of the protein families according to the presence of domains and sequence relatedness to previously described proteins. For example, the NOV31 nucleic acids and their encoded polypeptides include 7tm_1 7 transmembrane receptor (rhodopsin family) domain and sequence homology that are characteristic of proteins belonging to the family of GPCR such as the G protein-coupled olfactory receptor. The NOV31 protein of the invention has a high homology to the 7tm_1 domain (PFam Acc. No. pfam00001). The 7tm_1 domain is from the 7 transmembrane receptor family, which includes a number of different proteins, including, for example, serotonin receptors, dopamine receptors, histamine receptors, andrenergic receptors, cannabinoid receptors, angiotensin II receptors, chemokine receptors, opioid receptors, G-protein coupled receptor (GPCR) proteins, olfactory receptors (OR), and the like.

G-Protein Coupled Receptor proteins ("GPCRs") have been identified as a large family of G protein-coupled receptors in a number of species. These receptors share a seven transmembrane domain structure with many neurotransmitter and hormone receptors, and are likely to underlie the recognition and G-protein-mediated transduction of various signals. Human GPCR generally do not contain introns and belong to four different gene subfamilies, displaying great sequence variability. These genes are dominantly expressed in olfactory epithelium. See, e.g., Ben-Arie et al., Hum. Mol. Genet. 3:229–235(1994); and, Online Mendelian Inheritance in Man ("OMIM") entry # 164342 (http://www.ncbi.nlm.nih.gov/entrez/dispomim.cgi?).

The NOV31 nucleic acids and polypeptides, antibodies and related compounds according to the invention will be useful in therapeutic and diagnostic applications in the mediation of cellular signal transduction. As such the NOV31 nucleic acids and polypeptides, antibodies and related compounds according to the invention may be used to treat a wide range of disorders such as cancer, immune disorders, endocrine disorders and other diseases, e.g. developmental diseases; MHCII and III diseases (immune diseases); taste and scent detectability disorders; Burkitt's lymphoma; corticoneurogenic disease; signal transduction pathway disorders; metabolic pathway disorders; retinal diseases including those involving photoreception; cell growth rate disorders; cell shape disorders; metabolic disorders; feeding disorders; control of feeding; the metabolic syndrome X; wasting disorders associated with chronic diseases; obesity; potential obesity due to over-eating or metabolic disturbances; potential disorders due to starvation (lack of appetite); diabetes; noninsulin-dependent diabetes mellitus (NIDDM); infectious disease; bacterial, fungal, protozoal and viral infections (particularly infections caused by HIV-1 or HIV-2); pain; cancer (including but not limited to neoplasm; adenocarcinoma; lymphoma; prostate cancer; uterus cancer); cancer-associated cachexia; anorexia; bulimia; asthma; Parkinson's disease; acute heart failure; hypotension; hypertension; urinary retention; osteoporosis; Crohn's disease; multiple sclerosis; Albright Hereditary Ostoeodystrophy; angina pectoris; myocardial infarction; ulcers; allergies; benign prostatic hypertrophy; and psychotic and neurological disorders; including anxiety; schizophrenia; manic depression; delirium; dementia; neurodegenerative disorders; Alzheimer's disease; severe mental retardation; Dentatorubro-pallidoluysian atrophy (DRPLA); Hypophosphatemic rickets; autosomal dominant (2) Acrocallosal syndrome and dyskinesias, such as Huntington's disease or Gilles de la Tourette syndrome; immune disorders; Adrenoleukodystrophy; Congenital Adrenal Hyperplasia; Hemophilia; Hypercoagulation; Idiopathic thrombocytopenic purpura; autoimmume disease; immunodeficiencies; transplantation; Von Hippel-Lindau (VHL) syndrome; Stroke; Tuberous sclerosis; hypercalceimia; Cerebral palsy; Epilepsy; Lesch-Nyhan syndrome; Ataxia-telangiectasia; Leukodystrophies; Behavioral disorders; Addiction; Neuroprotection; Cirrhosis; Transplantation; Systemic lupus erythematosus; Emphysema; Scleroderma; ARDS; Renal artery stenosis; Interstitial nephritis; Glomerulonephritis; Polycystic kidney disease; Systemic lupus erythematosus; Renal tubular acidosis; IgA nephropathy; Cardiomyopathy; Atherosclerosis; Congenital heart defects; Aortic stenosis; Atrial septal defect (ASD); Atrioventricular (A-V) canal defect; Ductus arteriosus; Pulmonary stenosis; Subaortic stenosis; Ventricular septal defect (VSD); valve diseases; Scleroderma; fertility; Pancreatitis; Endocrine dysfunctions; Growth and reproductive disorders; Inflammatory bowel disease; Diverticular disease; Leukodystrophies; Graft vesus host; Hyperthyroidism; Endometriosis; and hematopoietic disorders.

The NOV31 nucleic acids and polypeptides are useful for detecting specific cell types. For example, expression analysis has demonstrated that a NOV31 nucleic acid is expressed in Apical microvilli of the retinal pigment epithelium, arterial (aortic), basal forebrain, brain, Burkitt lymphoma cell lines, corpus callosum, cardiac (atria and ventricle), caudate nucleus, CNS and peripheral tissue, cerebellum, cerebral cortex, colon, cortical neurogenic cells, endothelial (coronary artery and umbilical vein) cells, palate epithelia, eye, neonatal eye, frontal cortex, fetal hematopoietic cells, heart, hippocampus, hypothalamus, leukocytes, liver, fetal liver, lung, lung lymphoma cell lines, fetal lymphoid tissue, adult lymphoid tissue, Those that express MHC II and III nervous, medulla, subthalamic nucleus, ovary, pancreas, pituitary, placenta, pons, prostate, putamen, serum, skeletal muscle, small intestine, smooth muscle (coronary artery in aortic) spinal cord, spleen, stomach, taste receptor cells of the tongue, testis, thalamus, and thymus tissue.

Additional utilities for NOV31 nucleic acids and polypeptides according to the invention are disclosed herein.

NOV32

A NOV32 polypeptide has been identified as a Phosphoenolpyruvate Carboxykinase (PCK)-like protein (also referred to as 153065222). The disclosed novel NOV32 nucleic acid (SEQ ID NO:120) of 2069 nucleotides is shown in Table 32A. The cDNA coding for the NOV32 was cloned by polymerase chain reaction (PCR) using the following primers: CCTTCCATACCTCCCCGGCTC (SEQ ID NO:328) and TGTGGGAAGGTCTATGGCACATTGA (SEQ ID NO:329) on the following pools of human cDNAs: Pool 1—adrenal gland, bone marrow, brain—amygdala, brain—cerebellum, brain hippocampus, brain—substantia nigra, brain—thalamus, brain—whole, fetal brain, fetal kidney, fetal liver, fetal lung, heart, kidney, lymphoma—Raji, mammary gland, pancreas, pituitary gland, placenta, prostate, salivary gland, skeletal muscle, small intestine, spinal cord, spleen, stomach, testis, thyroid, trachea, uterus.

An ORF begins with Kozak consensus ATG initiation codon at nucleotides 67–69 and ends with a TGA codon at nucleotides 1891–1893. A putative untranslated region and/or downstream from the termination codon is underlined in Table 32A, and the start and stop codons are in bold letters.

variant sequence can include a single nucleotide polymorphism (SNP). A SNP can, in some instances, be referred to as a "cSNP" to denote that the nucleotide sequence containing the SNP originates as a cDNA.

NOV32 variant 13376584 is a G to A SNP at 116 bp of the nucleotide sequence that results in a Ser to Asn change at amino acid 17 of protein sequence, and variant 13376583 is

TABLE 32A

NOV32 Nucleotide Sequence (SEQ ID NO: 120)

CCCGCCTTCCATACCTCCCCGGCTCCGCTCGGTTCCTGGCCACCCCGCAGCCCCTGCCCAGGTGCCA
TGGCCGCATTGTACCGCCCTGGCCTGCGGCTTAACTGGCATGGGCTGAGCCCCTTGGGCTGGCCATC
ATGCCGTAGCATCCAGACCCTGCGAGTGCTTAGTGGAGATCTGGGCCAGCTTCCCACTGGCATTCGA
GATTTTGTAGAGCACAGTGCCCGCCTGTGCCAACCAGAGGGCATCCACATCTGTGATGGAACTGAGG
CTGAGAATACTGCCACACTGACCCTGCTGGAGCAGCAGGGCCTCATCCGAAAGCTCCCCAAGTACAA
TAACTGCTGGCTGGCCCGCACAGACCCCAAGGATGTGGCACGAGTAGAGAGCAAGACGGTGATTGTA
ACTCCTTCTCAGCGGGACACGGTACCACTCCCGCCTGGTGGGGCCTGTGGGCAGCTGGGCAACTGGA
TGTCCCCAGCTGATTTCCAGCGAGCTGTGGATGAGAGGTTTCCAGGCTGCATGCAGGGCCGCACCAT
GTATGTGCTTCCATTCAGCATGGGTCCTGTGGGCTCCCCGCTGTCCCGCATCGGGGTGCAGCTCACT
GACTCAGCCTATGTGGTGGCAAGCATGCGTATTATGACCCGACTGGGGACACCTGTGCTTCAGGCCC
TGGGAGATGGTGACTTTGTCAAGTGTCTGCACTCCGTGGGCCAGCCCCTGACAGGACAAGGGGAGCC
AGTGAGCCAGTGGCCGTGCAACCCAGAGAAAACCCTGATTGGCCACGTGCCCGACCAGCGGGAGATC
ATCTCCTTCGGCAGCGGCTATGGTGGCAACTCCCTGCTGGGCAAGAAGTGCTTTGCCCTACGCATCG
CCTCTCGGCTGGCCCGGGATGAGGGCTGGCTGGCAGAGCACATGCTGATCCTGGGCATCACCAGCCC
TGCAGGGAAGAAGGCGCTATGTGCAGCCGCCTTCCCTAGTGCCTGTGGCAAGACCAACCTGGCTATG
ATGCGGCCTGCACTGCCAGGCTGGAAAGTGGAGTGTGTGGGGGATGATATTGCTTGGATGAGGTTTG
ACAGTGAAGGTCGACTCCGGGCCATCAACCCTGAGAACGGCTTCTTTGGGGTTGCCCCTGGTACCTC
TGCCACCACCAATCCCAACGCCATGGCTACAATCCAGAGTAACACTATTTTTACCAATGTGGCTGAG
ACCAGTGATGGTGGCGTGTACTGGGAGGGCATTGACCAGCCTCTTCCACCTGGTGTTACTGTGACCT
CCTGGCTGGGCAAACCCTGGAAACCTGGTGACAAGGAGCCCTGTGCACATCCCAACTCTCGATTTTG
TGCCCCGGCTCGCCAGTGCCCCATCATGGACCCAGCCTGGGAGGCCCCAGAGGGTGTCCCCATTGAC
GCCATCATCTTTGGTGGCCGCAGACCCAAAGGGAAGATCATCATGCACGACCCATTTGCCATGCGGC
CCTTTTTTGGCTACAACTTCGGGCACTACCTGGAACACTGGCTGAGCATGGAAGGGCGCAAGGGGGC
CCAGCTGCCCCGTATCTTCCATGTCAACTGGTTCCGGCGTGACGAGGCAGGGCACTTCCTGTGGCCA
GGCTTTGGGGAGAATGCTCGGGTGCTAGACTGGATCTGCCGGCGGTTAGAGGGGGAGGACAGTGCCC
GAGAGACACCCATTGGGCTGGTGCCAAAGGAAGGAGCCTTGGATCTCAGCGGCCTCAGAGCTATAGA
CACCACTCAGCTGTTCTCCCTCCCCAAGGACTTCTGGGAACAGGAGGTTCGTGACATTCGGAGCTAC
CTGACAGAGCAGGTCAACCAGGATCTGCCCAAAGAGGTGTTGGCTGAGCTTGAGGCCCTGGAGAGAC
GTGTGCACAAAATGTGACCTGAGGCCTAGTCTAGCAAGAGGACATAGCACCCTCATCTGGGAATAGG
GAAGGCACCTTGCAGAAAATATGAGCAATTGATATTAACTAACATCTTCAATGTGCCATAGACCTTC
CCACAAAGACTGTCCAATAATAAGAGATGCTTATCTATTTTAAAAAAAAAAAAAAAAAAAA

The NOV32 protein (SEQ ID NO:121) encoded by SEQ ID NO:120 is 608 amino acid residues in length and is presented using the one-letter amino acid code in Table 32B. NOV32 has two SNP variants, whose variant positions for its nucleotide and amino acid sequences is numbered according to SEQ ID NOS:120 and 121, respectively. A a C to T SNP at 1297 bp of the nucleotide sequence that results in a Pro to Ser change at amino acid 411 of protein sequence.

Psort analysis predicts the NOV32 protein of the invention to be localized in the mitochondria with a certainty of 0.5801.

TABLE 32B

Encoded NOV32 protein sequence (SEQ ID NO: 121)

MAALYRPGLRILNWHGLSPLGWPSCRSIQTLRVLSGDLGQLPTGIRDFVEHSARLCQPEGIHICDGTEAENTAT
LTLLEQQGLIRKLPKYNNCWLARTDPKDVARVESKTVIVTPSQRDTVPLPPGGACGQLGNWMSPADFQRAVDE
RFPGCMQGRTMYVLPFSMGPVGSPLSRIGVQLTDSAYVVASMRIMTRLGTPVLQALGDGDFVKCLHSVGQPLT
GQGEPVSQWPCNPEKTLIGHVPDQREIISFGSGYGGNSLLGKKCFALRIASRLARDEGWLAEHMLILGITSPA
GKKALCAAAFPSACGKTNLAMMRPALPGWKVECVGDDIAWMRFDSEGRLRAINPENGFFGVAPGTSATTNPNA
MATIQSNTIFTNVAETSDGGVYWEGIDQPLPPGVTVTSWLGKPWKPGDKEPCAHPNSRFCAPARQCPIMDPAW
EAPEGVPIDAIIFGGRRPKGKIIMHDPFAMRPFFGYNFGHYLEHWLSMEGRKGAQLPRIFHVNWFRRDEAGHF
LWPGFGENARVLDWICRRLEGEDSARETPIGLVPKEGALDLSGLRAIDTTQLFSLPKDFWEQEVRDIRSYLTE
QVNQDLPKEVLAELEALERRVHKM

A search against the Patp database, a proprietary database that contains sequences published in patents and patent publications, yielded several homologous proteins shown in Table 32C.

TABLE 32C

Patp results for NOV32

| Sequences producing High-scoring Segment Pairs: | Reading Frame | High Score | Smallest Sum Prob P (N) |
|---|---|---|---|
| >patp: AAY80296 Human mitochondrial PEPCK | +1 | 2494 | 0.0 |
| >patp: AAB71890 Mouse PCK-cytosolic protein | +1 | 1765 | 3.9e-238 |
| >patp: AAB71880 Human PCK-cytosolic protein | +1 | 1763 | 1.4e-235 |
| >patp: AAR15144 *Haemonchus contortus* PEPCK | +1 | 1410 | 1.2e-194 |
| >patp: AAY35500 *Chlamydia pneumoniae* transmembrane protein | +1 | 1251 | 1.4e-161 |

In a BLAST search of public sequence databases, it was found, for example, that the NOV32 nucleic acid sequence of this invention has 1557 of 1636 bases (95%) identical to a gb:GENBANK-ID:HSPPPCK|acc:X92720.1 mRNA from *Homo sapiens* (mRNA for phosphoenolpyruvate carboxykinase). The full amino acid sequence of the protein of the invention was found to have 459 of 469 amino acid residues (97%) identical to, and 463 of 469 amino acid residues (98%) similar to, the 640 amino acid residue ptnr:SWISSPROT-ACC:Q16822 protein from *Homo sapiens* (PHOSPHOENOLPYRUVATE CARBOXYKINASE, MITOCHONDRIAL PRECURSOR [GTP] (EC 4.1.1.32) (PHOSPHOENOLPYRUVATE CARBOXYLASE) (PEPCK-M)).

NOV32 also has homology to the proteins shown in the BLASTP data in Table 32D.

TABLE 32D

BLAST results for NOV32

| Gene Index/Identifier | Protein/Organism | Length (aa) | Identity (%) | Positives (%) | Expect |
|---|---|---|---|---|---|
| gi|14750965|ref|XP_033337.1| (XM_033337) | phosphoenolpyruvate carboxykinase 2 (mitochondrial) [*Homo sapiens*] | 640 | 577/640 (90%) | 577/640 (90%) | 0.0 |
| gi|3287892|sp|Q16822| | PPCM_HUMAN PHOSPHOENOLPYRUVATE CARBOXYKINASE, MITOCHONDRIAL PRECURSOR [GTP] (PHOSPHOENOLPYRUVATE CARBOXYLASE) (PEPCK-M) | 640 | 581/640 (90%) | 581/640 (90%) | 0.0 |
| gi|16307539|gb|AAH10318.1| AAH10318 (BC010318) | Similar to phosphoenolpyruvate carboxykinase 2 (mitochondrial) [*Mus musculus*] | 640 | 530/624 (84%) | 549/624 (87%) | 0.0 |
| gi|12655193|gb|AAH01454.1| AAH01454 (BC001454) | phosphoenolpyruvate carboxykinase 2 (mitochondrial) [*Homo sapiens*] | 640 | 578/640 (90%) | 578/640 (90%) | 0.0 |
| gi|4758886|ref|NP_004554.1| (NM_004563) | phosphoenolpyruvate carboxykinase 2 (mitochondrial) [*Homo sapiens*] | 640 | 582/640 (90%) | 582/640 (90%) | 0.0 |

A multiple sequence alignment is given in Table 32E, with the NOV32 protein being shown on line 1 in Table 32E in a ClustalW analysis, and comparing the NOV32 protein with the related protein sequences shown in Table 32D. This BLASTP data is displayed graphically in the ClustalW in Table 32E.

Table 32E. ClustalW Analysis of NOV32

1) > NOV32; SEQ ID NO:121
2) > gi|1475096/ Phosphoenolpyruvate carboxykinase 2 (mitochondrial) [*Homo sapiens*]; SEQ ID NO:330
3) > gi|3287892/ PPCM_human phospoenolpyruvate carboxykinase, mitochondrial precursor [GTP]; SEQ ID NO:331
4) > gi|1630753/ Similar to phosphoenolpyruvate carboxykinase 2 (mitochondrial) [*Mus musculus*]; SEQ ID NO:332
5) > gi|1265519/ phosphoenolpyruvate carboxykinase 2 (mitochondrial) [*Homo sapiens*] ; SEQ ID NO:333
6) > gi|4758886/ phosphoenolpyruvate carboxykinase 2 (mitochondrial) [*Homo sapiens*]; SEQ ID NO:334

```
                        10         20         30         40         50
                 ....|....|....|....|....|....|....|....|....|....|
NOV32            MAALYRPGLRLNWHGLSPLGWPSCRSIQTLRVLSGDLGQLPTGIRDFVEH
gi|1475096       MAALYRPGLRLNWHGLSPLGWPSCRSIQTLRVLSGDLGQLPTGIRDFVEH
gi|3287892       MAALYRPGLRLNWHGLSPLGWPSCRSIQTLRVLSGDLGQLPTGIRDFVEH
gi|1630753       MAAMYLPGLRLSRHGLRPWCWSPCRSIQTLRVLSGDMSQLPAGVRDFVAR
gi|1265519       MAALYRPGLRLNWHGLSPLGWPSCRSIQTLRVLSGDLGQLPTGIRDFVEH
gi|4758886       MAALYRPGLRLNWHGLSPLGWPSCRSIQTLRVLSGDLGQLPTGIRDFVEH 60         70         80         90        100
                 ....|....|....|....|....|....|....|....|....|....|
NOV32            SARLCQPEGIHICDGTEAENTATLTLLEQQGLIRKLPKYNNCWLARTDPK
gi|1475096       SARLCQPEGIHICDGTEAENTATLTLLEQQGLIRKLPKYNNCWLARTDPK
gi|3287892       SARLCQPEGIHICDGTEAENTATLTLLEQQGLIRKLPKYNNCWLARTDPK
gi|1630753       SAHLCQPEGIHICDGTEAENTAILALLEEQGLIRKLPKYKNCWLARTDPK
gi|1265519       SARLCQPEGIHICDGTEAENTATLTLLEQQGLIRKLPKYNNCWLARTDPK
gi|4758886       SARLCQPEGIHICDGTEAENTATLTLLEQQGLIRKLPKYNNCWLARTDPK 110        120        130        140        150
                 ....|....|....|....|....|....|....|....|....|....|
NOV32            DVARVESKTVIVTPSQRDTVPLPPGGACGQLGNWMSPADFQRAVDERFPG
gi|1475096       DVARVESKTVIVTPSQRDTVQLPPGGARGQLGNWMSPADF----------
gi|3287892       DVARVESKTVIVTPSQRDTVPLPPGGARGQLGNWMSPADF----------
gi|1630753       DVARVESKTVIVTPSQRDTVPLAGGARGQLGNWMSPDEF----------
gi|1265519       DVARVESKTVIVTPSQRDTVPLPPGGARGQLGNWMSPADF----------
gi|4758886       DVARVESKTVIVTPSQRDTVPLPPGGACGQLGNWMSPADF----------
```

NOV32 Clustal W alignment shown in Table 32E was modified to end at amino residue 150. The data in Table 32E includes all of the regions overlapping with the NOV32 protein sequences.

The presence of identifiable domains in the protein disclosed herein was determined by searches using algorithms such as PROSITE, Blocks, Pfam, ProDomain, Prints and then determining the Interpro number by crossing the domain match (or numbers) using the Interpro website (http:www.ebi.ac.uk/interpro/). Table 32F lists the domain description from DOMAIN analysis results against NOV32.

TABLE 32F

Domain Analysis of NOV32

| Model | Region of Homology | Score (bits) | E value |
|---|---|---|---|
| Phosphoenol-pyruvate carboxykinase | 46–456 | 1193.2 | 0 |
| Phosphoenol-pyruvate carboxykinase | 457–608 | 381.5 | 4.5e-112 |

Consistent with other known members of the PCK family of proteins, NOV32 contains phosphoenolpyruvate carboxykinase domains as illustrated in Table 32F. NOV32 nucleic acids, and the encoded polypeptides, according to the invention are useful in a variety of applications and contexts. For example, NOV32 nucleic acids and polypeptides can be used to identify proteins that are members of the PCK family of proteins. The NOV32 nucleic acids and polypeptides can also be used to screen for molecules, which inhibit or enhance NOV32 activity or function. Specifically, the nucleic acids and polypeptides according to the invention may be used as targets for the identification of small molecules that modulate or inhibit, e.g., gluconeogenesis. These molecules can be used to treat, e.g., hypoglycemia and other diseases, disorders and conditions of the like.

In addition, various NOV32 nucleic acids and polypeptides according to the invention are useful, inter alia, as novel members of the protein families according to the presence of domains and sequence relatedness to previously described proteins. For example, the NOV32 nucleic acids and their encoded polypeptides include structural motifs and homology that are characteristic of proteins belonging to the family of PCK proteins which.

Phosphoenolpyruvate carboxykinase (GTP) (PCK; EC 4.1.1.32) catalyzes the formation of phosphoenolpyruvate by decarboxylation of oxaloacetate while hydrolyzing GTP, a rate limiting step in gluconeogenesis (the biosynthesis of glucose). In vertebrates there are two isozymes: a cytosolic form whose activity is affected by hormones regulating this metabolic process (such as glucagon, or insulin) and a mitochondrial form. The activity is about equally distributed between cytosol and mitochondria in human liver. In contrast, PCK is essentially a cytosolic enzyme in rat liver. See also PCK1 (261680), the human cytosolic PCK enzyme. Modaressi et al. (1996) cloned and sequenced the cDNA of the mitochondrial form of hepatic PCK (Biochem J., 315 (Pt 3):807–14 (1996)). The gene encodes a 640-amino acid polypeptide. The gene has has an overall 68% DNA sequence identity and a 70% deduced amino acid sequence identity with human cytosolic PCK cDNA. Expression studies were also reported.

Deficiencies in PKC2 (PEPCK2) have been documented. In 2 unrelated children, Hommes et al. (1976) observed hypoglycemia and liver impairment, with deficiency of PEPCK in liver tissue taken immediately after death (Acta Paediatr Scand., 65(2):233–40 (1976)). Massive fatty deposition in liver and kidneys was found at autopsy. Fiser et al. (1974) also observed hypoglycemia caused by deficiency of PEPCK (Am J Obstet Gynecol., 120(7):944–50(1974)). Other enzymatic causes of hypoglycemia include deficiency of glucose-6-phosphatase (232200), fructose-1,6-diphosphatase (229700), and pyruvate carboxylase (266150). Vidnes and Sovik (1976) described a case of persistent neonatal hypoglycemia in which only the extramitochondrial (i.e., cytosolic) form of hepatic phosphoenolpyruvate carboxykinase (PCK1) was deficient (Acta Paediatr Scand., 65(3):307–12(1976)). Phosphoenolpyruvate carboxykinase can be measured in fibroblasts, which are said to contain only mitochondrial PEPCK (Clayton et al., Eur J Pediatr., 145(1–2):46–50(1986)). Clayton et al. (1986) reported this disorder in a female child who died of liver failure at 6 months and probably in her brother who died a crib death at 4 weeks (Eur J Pediatr., 145(1–2):46–50(1986)). Leonard et al. (1991) studied the next child in this family, a boy who developed a similar illness with liver failure (Eur J Pediatr., 150(3):198–9(1991)). PEPCK activity in leukocytes and fibroblasts was normal, however, leading Leonard et al. (1991) to conclude that the primary defect in this family does not reside in this enzyme (Eur J Pediatr., 150(3):198–9 (1991)). Subsequent studies of a third affected child in this family by Bodnar et al. (1993) suggested that the sibs suffered from the mitochondrial DNA depletion syndrome (251880) and that this depletion is controlled by the nuclear genome (Am J Hum Genet., 53(3):663–9(1993)).

The NOV32 nucleic acids and polypeptides, antibodies and related compounds according to the invention will be useful in therapeutic and diagnostic applications in regulating glucose metabolism. As such the NOV32 nucleic acids and polypeptides, antibodies and related compounds according to the invention may be used to treat metabolic disorders, e.g., hypoglycemia.

The NOV32 nucleic acids and polypeptides are useful for detecting specific cell types. For example, expression analysis has demonstrated that a NOV32 nucleic acid is expressed in Liver, Adipose, Adrenal Gland/Suprarenal gland, Bone, Bone Marrow, Brain, Brown adipose, Cartilage, Cervix, Colon, Duodenum, Heart, Kidney, Kidney Cortex, Left cerebellum, Lung, Lymphoid tissue, Mammary gland/Breast, Ovary, Pancreas, Placenta, Prostate, Retina, Skin, Small Intestine, Spinal Chord, Stomach, Substantia Nigra, Synovium/Synovial membrane, Testis, Tonsils, Uterus, Vulva, Whole Organism.

Additional utilities for NOV32 nucleic acids and polypeptides according to the invention are disclosed herein.

NOV33

A NOV33 polypeptide has been identified as a G Protein-Coupled Receptor (GPCR)-like protein (also referred to as CG56610-01). The disclosed novel NOV33 nucleic acid (SEQ ID NO:122) of 924 nucleotides is shown in Table 33A. An ORF begins with an AAA codon which codes for the amino acid lysine at nucleotides 3–5 and ends with a TGA codon at nucleotides 912–914. A putative untranslated region and/or downstream from the termination codon is underlined in Table 33A, and the start and stop codons are in bold letters.

TABLE 33A

NOV33 Nucleotide Sequence (SEQ ID NO: 122)

CTAAATTTCCAACCTTCTTGTTGACCGGCATTCCTGGCCTAGAGTCTGCCCATGTCTGGATCTCCAT
TCCTTTCTGTTGTTTTTATGCCATTGCCCTCTCTGGGAACAGCGTGATCCTGTTTGTCATCATTACC
CAGCAGAGTCTCCATGAACCCATGTATTATTTCCTCTTCAGGCTATCAGCCACTGATCTGGACTTGA
CTGTTTCTTCATTGTCAACAACATTAGGTATTCTCTGGTTTGAGGCACGTGAAATCAGTCTATATAG
CTGCATTGTCCAGATGTTTTTTCTTCATGGATTCACTTTTATGGAATCTGGAGTGCTGGTGGCTACA
GCCTTTGACCGTTATGCGGCCATCTGTGACCCTCTGAGGTACACTACCATTCTCACTAATTCCAGAA
TCATTCAAATGGGTCTTCTGATGATTACACGTGCTATAGTACTAATATTGCCACTACTTTTGCTCCT
TAAGCCTCTCTATTTCTGTAGAATGAATGCCCTTTCTCACTCCTATTGTTACCATCCAGATGTGATT
CAATTAGCATGTTCAGACATTCGGGCAAATAGCATCTGTGGATTAACTGATCTCATCCTGACCACTG
GAATAGATACACCATGCATTGTCCTGTCATATATCTTAATTATTCACTCTGTCCTCAGAATTGCCTC
CCCTGAAGAATGGCACAAGGTCTTCAGCACCTGTGTCTCCCATGTGGGAGCAGTTGCTTTCTTCTAC
ATCCACATGCTGAGCCTGTCCTTGGTGTATCGCTATGGTCGGTCAGCCCCCAGAGTAGTCCATTCAG
TGATGGCTAATGTATACCTGCTTTTACCCCCTGTGCTCAACCCCATCATCGACAGTGTAAAAACAAA
ACAAATCCGCAAGGCTATGCTCAGTCTGCTGCTTACAAAATGAACAGACATAG

The NOV33 protein (SEQ ID NO:123) encoded by SEQ ID NO:122 is 303 amino acid residues in length and is presented using the one-letter amino acid code in Table 33B. Psort analysis predicts the NOV33 protein of the invention to be localized at the plasma membrane with a certainty of 0.6000. The Signal P predicts a likely cleavage site for a NOV33 peptide is between positions 33 and 34, i.e., at the dash in the sequence ALS-GN.

TABLE 33B

Encoded NOV33 protein sequence (SEQ ID NO: 123)

KFPTFLLTGIPGLESAHVWISIPFCCFYAIALSGNSVILFVIITQQSLHEPMYYFLFRLSATDLD
LTVSSLSTTLGILWFEAREISLYSCIVQMFFLHGFTFMESGVLVATAFDRYAAICDPLRYTTILT
NSRIIQMGLLMITRAIVLILPLLLLLKPLYFCRMNALSHSYCYHPDVIQLACSDIRANSICGLTD
LILTTGIDTPCIVLSYILIIHSVLRIASPEEWHKVFSTCVSHVGAVAFFYIHMLSLSLVYRYGRS
APRVVHSVMANVYLLLPPVLNPIIDSVKTKQIRKAMLSLLLTK

A search against the Patp database, a proprietary database that contains sequences published in patents and patent publications, yielded several homologous proteins shown in Table 33C.

TABLE 33C

Patp results for NOV33

| Sequences producing High-scoring Segment Pairs: | Reading Frame | High Score | Smallest Sum Prob P (N) |
|---|---|---|---|
| >patp: AAG71696 Human olfactory receptor polypeptide | +1 | 1501 | 1.1e-153 |
| >patp: AAG71724 Human olfactory receptor polypeptide | +1 | 1028 | 1.4e-103 |
| >patp: AAG71510 Human olfactory receptor polypeptide | +1 | 935 | 1.0e-93 |
| >patp: AAG72487 Human OR-like polypeptide query sequence | +1 | 935 | 1.0e-93 |
| >patp: AAG71698 Human olfactory receptor polypeptide | +1 | 819 | 2.0e-81 |

In a BLAST search of public sequence databases, it was found, for example, that the NOV33 nucleic acid sequence of this invention has 579 of 905 bases (63%) identical to a gb:GENBANK-ID:AF133300|acc:AF133300.2 mRNA from *Mus musculus* (MOR 3'Beta1, MOR 3'Beta2, MOR 3'Beta3, and MOR 3'Beta4 genes, complete cds; Cbx3 pseudogene, complete sequence; and MOR 3'Beta5 and MOR 3'Beta6 genes, complete cds). NOV33 polypeptide of the invention was found to have 155 of 295 amino acid residues (52%) identical to, and 208 of 295 amino acid residues (70%) similar to, the 312 amino acid residue ptnr:TREMBLNEW-ACC:AAG41678 protein from *Homo sapiens* (HOR5'BETA12).

NOV33 also has homology to the proteins shown in the BLASTP data in Table 33D.

TABLE 33D

BLAST results for NOV33

| Gene Index/Identifier | Protein/Organism | Length (aa) | Identity (%) | Positives (%) | Expect |
|---|---|---|---|---|---|
| gi|17456801|ref|XP_061626.1| (XM_061626) | similar to OLFACTORY RECEPTOR 51I2 (HOR5BETA12) [Homo sapiens] | 342 | 159/299 (53%) | 197/299 (65%) | 2e-72 |
| gi|17456767|ref|XP_061618.1| (XM_061618) | similar to prostate specific G-protein coupled receptor [Homo sapiens] | 879 | 128/290 (44%) | 172/290 (59%) | 2e-56 |
| gi|17456777|ref|XP_061621.1| (XM_061621) | similar to olfactory receptor-like protein COR3beta [Homo sapiens] | 327 | 132/299 (44%) | 172/299 (57%) | 2e-55 |
| gi|11991863|gb|AAG42364.1| (AF289204) | odorant receptor HOR'beta1 [Homo sapiens] | 321 | 136/300 (45%) | 178/300 (59%) | 3e-55 |
| gi|17472781|ref|XP_061811.1| (XM_061811) | similar to OLFACTORY RECEPTOR 51I2 (HOR5BETA12) [Homo sapiens] | 312 | 128/295 (43%) | 169/295 (56%) | 1e-54 |

A multiple sequence alignment is given in Table 33E, with the NOV33 protein being shown on line 1 in Table 33E in a ClustalW analysis, and comparing the NOV33 protein with the related protein sequences shown in Table 33D. This BLASTP data is displayed graphically in the ClustalW in Table 33E.

Table 33E. ClustalW Analysis of NOV33

1) > NOV33; SEQ ID NO:123
2) > gi|1745680/ similar to olfactory receptor 5112 [*Homo sapiens*]; SEQ ID NO:335
3) > gi|1745676/ similar to prostate specific G-protein coupled receptor [*Homo sapiens*]; SEQ ID NO:336
4) > gi|1745677/ similar to olfactory receptor-like protein COR3beta [*Homo sapiens*] ; SEQ ID NO:337
5) > gi|1199186/ odorant receptor HOR'3beta1 [*Homo sapiens*] ; SEQ ID NO:338
6) > gi|1747278/ similar to olfactory receptor 5112 [*Homo sapiens*]; SEQ ID NO:339

```
                      560       570       580       590       600
                ....|....|....|....|....|....|....|....|....|....|
NOV33           --------------KFPT------------FLLTGIPGLESAHVWISIP
gi|1745680      -----MTETSLSSQCFPMS-VLNNTIAEPLIFLLMGIPGLKATQYWISIP
gi|1745676      QDFGGHPPSPLSPHTMTLGSLGNSSSSVSATFLISGIPGLERMHIWISIP
```

```
gi|1745677    -----MAIFNNTTSSSSN-------------FLLTAFPGLECAHVWISIP
gi|1199186    --------MFLSSRMITS---VSPSTSTNSSFLLTGFSGMEQQYPWFSIP
gi|1747278    --------------------MGLFNVTHPAFFLLTGIPGLESSHSWLSGP
```

```
                       610        620        630        640        650
                  ....|....|....|....|....|....|....|....|....|....|
NOV33         FCCFYAIALSGNSVILFVIITQQSLHEPMYYFLRLSATDLDLTVSSLST
gi|1745680    FCLLYVVAVSGNSMILFVVLCERSLHKPMYYFLSMLSATDLSLSLCTLST
gi|1745676    LCFMYLVSIPGNCTILFIIKTERSLHEPMYLFLSMIALIDLGLSLCTLPT
gi|1745677    VCCLYTIALLGNSMIFLVIIKRRLHKPMYYFLSMIAAVDLCLTITTLPT
gi|1199186    FSSIYAMVLLGNCMVIHVIWTEPSLHQPMFYFLSMIALTDLCMGLSTVYT
gi|1747278    LCVMYAVALGGNTVIIQAVRVEPSLHEPMYYFLSMLSFSDVAISMATLPT
```

```
                       660        670        680        690        700
                  ....|....|....|....|....|....|....|....|....|....|
NOV33         TLGILWFEAREISLYSCIVQMFFLHGFTFMESGVLVATAFDRYAAICDPL
gi|1745680    TLGVFWFEAREINLNACIAQMFFLHGFTFMESGVLLAMAFDRFVAICYPL
gi|1745676    VLGIFWVGAREISHDACFAQLFFIHCFSELESSVLLSMAFDREVAICHPL
gi|1745677    VLGVLWFHAREISFKACFIQMFFVHAFSLLESSVLVAMAFDRFVAICNPL
gi|1199186    VLGILWRIIREISLDSCIAQSYFIHGLSFMESSVLITMAFDRYIAICNPL
gi|1747278    VLRTFCLNARNITFDACLIQMFLIHFFSMMESGILLAMSFDRYVAICDPL
```

```
                       710        720        730        740        750
                  ....|....|....|....|....|....|....|....|....|....|
NOV33         RYTTILTNSRIQMGLLMITRAIVLILPLLLLKPLYFCRMNALSHSYCY
gi|1745680    RYTTILTNARIAKIGMSMLIRNVAVMLPVMLFVKRLSFCSSMVLSHSYCY
gi|1745676    HYVSILTNTVIGRIGIVSLGRSVALIFPLPFMLKRFPYCGSPVLSHSYCL
gi|1745677    NYATILTDRMVLVIGLVICIRPAVFLLPLLVAINTVSFHGGHELSHPFCY
gi|1199186    RYSSILTNSRTIKIGLTIIGRSFFFITPPIICLKFFNYCHFHILSHSFCL
gi|1747278    RYATVLTTEVIAAMGLGAAARSFITLFPLPFLIKRLPICRSNVLSHSYCL
```

```
                       760        770        780        790        800
                  ....|....|....|....|....|....|....|....|....|....|
NOV33         HPDVIQLACSDIRANSICGLTDLILTTGIDTPCIVLSYILIIHSVLRIAS
gi|1745680    HVDLIQLSCTDNRINSILGLFALLSTTGFDCPCILLSYILIIRSVLSIAS
gi|1745676    HQEVMKLACDMKANSIYGMFVIVSTVGIDSLLILFSYALILRTVLSIAS
gi|1745677    HPEVIKYTSKPWISSFWGLFLQLYLNGTDVLFILFSYVLILRTVLGIVA
gi|1199186    HQDLLRLACSDIRFNSYYALMLVICILLLDAILILFSYILILKSVLAVAS
gi|1747278    HPDMMRLACADISINSIYGLFVLVSTFGMDLFFIFLSYVLILRSVMATAS
```

```
                       810        820        830        840        850
                  ....|....|....|....|....|....|....|....|....|....|
NOV33         PEEWHKVFSTCVSHVGAVAFFYIHMLSLSLVYRYGRSAPRVVHSVMANVY
gi|1745680    SEERRKAFNTCTSHISAVSIFYLPLTSLSLVHRYGHSAPPFVHIIMANVF
gi|1745676    RAERFKALNTCVSHICAVLLFYTPMIGLSVIHRFGKQAPHLVQVVMGFMY
gi|1745677    RKKQQKALSTCVCHICAVTIFYVPLISLSLAHRLFHSTPRVLCSTLANIY
gi|1199186    QEERHKLFQTCISHICAVLVFYIPIISLTMVHRFGKHLSPVAHVLIGNIY
gi|1747278    REERLKALNTCVSHICAVLAFYVPMIGVSTVHRFGKHVPCYIHVLMSNVY
```

```
                       860        870        880        890
                  ....|....|....|....|....|....|....|....|....|....
NOV33         LLLPPVLNPIIDSVKTKQIRKAMLSLLLTK-----------------
gi|1745680    LLIPPVLNPIIYSVKIKQIQKAIIKVLIQKHSKSNHQLFLIRDKAIYE
gi|1745676    LLFPPVMNPIVYSVKTKQIRDRVTHAFCY-------------------
gi|1745677    LLLPPVLNPIIYSLKTKTIRQAMFQLLQSKGSWGFNVRGLRGRWD---
gi|1199186    ILFPPLMNPIIYSVKTQQIHTRMLRLFSLKRY----------------
gi|1747278    LFVPPVLNPLIYSAKTKEIRRAIFRMFHHIKI----------------
```

The NOV33 Clustal W alignment shown in Table 33E was modified to begin at amino residue 551. The data in Table 33E includes all of the regions overlapping with the NOV33 protein sequences.

The presence of identifiable domains in the protein disclosed herein was determined by searches using algorithms such as PROSITE, Blocks, Pfam, ProDomain, Prints and then determining the Interpro number by crossing the domain match (or numbers) using the Interpro website (http:www.ebi.ac.uk/interpro/). The DOMAIN analysis results indicate that the NOV33 protein contains the following protein domain (as defined by Interpro): domain name 7tm_1 7 transmembrane receptor (rhodopsin family). DOMAIN results for NOV33 were collected from the Conserved Domain Database (CDD) with Reverse Position Specific BLAST. This BLAST samples domains found in the Smart and Pfam collections.

As discussed below, the NOV33 protein of the invention contained significant homology to the 7tm_1 domain. This indicates that the NOV33 sequence has properties similar to those of other proteins known to contain this 7tm_1 domain and similar to the properties of these domains. The 254 amino acid domain termed 7tm 1 (SEQ ID NO:340; Pfam Acc. No. 00001) a seven transmembrane receptor (rhodopsin family), is shown in Table 33F.

Consistent with other known members of the GPCR family of proteins, NOV33 contains 7tm 1 7 transmembrane receptor (rhodopsin family) domain as illustrated in Table 33G as well as homology and cellular localization, i.e. plasma membrane.

NOV33 nucleic acids, and the encoded polypeptides, according to the invention are useful in a variety of applications and contexts. For example, NOV33 nucleic acids and polypeptides can be used to identify proteins that are members of the GPCR family of proteins. The NOV33 nucleic acids and polypeptides can also be used to screen for molecules, which inhibit or enhance NOV33 activity or function. Specifically, the nucleic acids and polypeptides according to the invention may be used as targets for the identification of small molecules that modulate or inhibit, e.g., cellular signal transduction. These molecules can be used to treat, e.g., cancer, immune disorders, and endocrine disorders.

In addition, various NOV33 nucleic acids and polypeptides according to the invention are useful, inter alia, as novel members of the protein families according to the presence of domains and sequence relatedness to previously described proteins. For example, the NOV33 nucleic acids and their encoded polypeptides include 7tm_1 7 transmembrane receptor (rhodopsin family) domain and sequence

TABLE 33F

7tm_1, 7 transmembrane receptor domain (SEQ ID NO: 340)

GNLLVILVILRTKKLRTPTNIFLLNLAVADLLFLLTLPPWALYYLVGGWVFGDALCKLVGALFVVNGYASILLLTAISIDRYL
AIVHPLRYRRIRTPRRAKVLILLVWVLALLLSLPPLLFSWLRTVEEGNTTVCLIDFPEESVKRSYVLLSTLVGFVLPLLVILVC
YTRILRTLRKRARSQRSLKRRSSSERKAAKMLLVVVVVFVLCWLPYHIVLLLDSLCLLSIWRVLPTALLITLWLAYVNSCLNPI
IY

The DOMAIN results are listed in Table 33G with the statistics and domain description. An alignment of NOV33 residues 34–133 (SEQ ID NO:123) with the full 7tm_1 domain, residues 1–254 (SEQ ID NO:340), are shown in Table 33G. This indicates that the NOV33 sequences have properties similar to those of other proteins known to contain this domain as well as to the 254 amino acid 7tm domain (SEQ ID NO:340). For Table 33G, fully conserved single residues are indicated by the vertical line and "strong" semi-conserved residues are indicated by the "plus sign." The "strong" group of conserved amino acid residues may be any one of the following groups of amino acids: STA, NEQK, NHQK, NDEQ, QHRK, MILV, MILF, HY, FYW.

homology that are characteristic of proteins belonging to the family of GPCR such as the G protein-coupled olfactory receptor. The NOV33 protein of the invention has a high homology to the 7tm_1 domain (PFam Acc. No. pfam00001). The 7tm_1 domain is from the 7 transmembrane receptor family, which includes a number of different proteins, including, for example, serotonin receptors, dopamine receptors, histamine receptors, andrenergic receptors, cannabinoid receptors, angiotensin II receptors, chemokine receptors, opioid receptors, G-protein coupled receptor (GPCR) proteins, olfactory receptors (OR), and the like.

TABLE 33G

Domain Analysis of NOV33

| PSSMs producing significant alignments: | Score (bits) | E value |
|---|---|---|
| gnl\|Pfam\|pfam00001 7tm_1, 7 transmembrane receptor (rhodopsin family) | 42.1 | 1.5e-12 |

```
              *->GNlLVilvilrtkklrtptnifilNLAvADLLflltlppwalyylvg
                 GN+++++vi+ +++l+ p+++f++ L+ +DL ++++ +  +l +l++
NOV33     34     GNSVILFVIITQQSLHEPMYYFLFRLSATDLDLTVSSLSTTLGILWF 80 gsedWpfGsalCklvtaldvvnmyaSillLtaISiDRYlAIvhPlryrrr
                 e    ++ + C +++++    ++++    L+a ++DRY AI++Plry ++
NOV33     81  --EAREISLYSCIVQMFFLHGFTFMESGVLVATAFDRYAAICDPLRYTTI 128 rtsprr<-*        (SEQ ID NO:340)
              t    r
NOV33    129  LT-NSR     133  (SEQ ID NO:123)
```

G-Protein Coupled Receptor proteins ("GPCRs") have been identified as a large family of G protein-coupled receptors in a number of species. These receptors share a seven transmembrane domain structure with many neurotransmitter and hormone receptors, and are likely to underlie the recognition and G-protein-mediated transduction of various signals. Human GPCR generally do not contain introns and belong to four different gene subfamilies, displaying great sequence variability. These genes are dominantly expressed in olfactory epithelium. See, e.g., Ben-Arie et al., Hum. Mol. Genet. 3:229–235(1994); and, Online Mendelian Inheritance in Man ("OMIM") entry # 164342 (http://www.ncbi.nhn.nih.gov/entrez/dispomim.cgi?).

The NOV33 nucleic acids and polypeptides, antibodies and related compounds according to the invention will be useful in therapeutic and diagnostic applications in the mediation of cellular signal transduction. As such the NOV33 nucleic acids and polypeptides, antibodies and related compounds according to the invention may be used to treat a wide range of disorders such as cancer, immune disorders, endocrine disorders and other diseases, e.g., developmental diseases; MHCII and III diseases (immune diseases); taste and scent detectability disorders; Burkitt's lymphoma; corticoneurogenic disease; signal transduction pathway disorders; metabolic pathway disorders; retinal diseases including those involving photoreception; cell growth rate disorders; cell shape disorders; metabolic disorders; feeding disorders; control of feeding; the metabolic syndrome X; wasting disorders associated with chronic diseases; obesity; potential obesity due to over-eating or metabolic disturbances; potential disorders due to starvation (lack of appetite); diabetes; noninsulin-dependent diabetes mellitus (NIDDM); infectious disease; bacterial, fungal, protozoal and viral infections (particularly infections caused by HIV-1 or HIV-2); pain; cancer (including but not limited to neoplasm; adenocarcinoma; lymphoma; prostate cancer; uterus cancer); cancer-associated cachexia; anorexia; bulimia; asthma; Parkinson's disease; acute heart failure; hypotension; hypertension; urinary retention; osteoporosis; Crohn's disease; multiple sclerosis; Albright Hereditary Ostoeodystrophy; angina pectoris; myocardial infarction; ulcers; allergies; benign prostatic hypertrophy; and psychotic and neurological disorders; including anxiety; schizophrenia; manic depression; delirium; dementia; neurodegenerative disorders; Alzheimer's disease; severe mental retardation; Dentatorubro-pallidoluysian atrophy (DRPLA); Hypophosphatemic rickets; autosomal dominant (2) Acrocallosal syndrome and dyskinesias, such as Huntington's disease or Gilles de la Tourette syndrome; immune disorders; Adrenoleukodystrophy; Congenital Adrenal Hyperplasia; Hemophilia; Hypercoagulation; Idiopathic thrombocytopenic purpura; autoimmume disease; immunodeficiencies; transplantation; Von Hippel-Lindau (VHL) syndrome; Stroke; Tuberous sclerosis; hypercalceimia; Cerebral palsy; Epilepsy; Lesch-Nyhan syndrome; Ataxia-telangiectasia; Leukodystrophies; Behavioral disorders; Addiction; Neuroprotection; Cirrhosis; Transplantation; Systemic lupus erythematosus; Emphysema; Scleroderma; ARDS; Renal artery stenosis; Interstitial nephritis; Glomerulonephritis; Polycystic kidney disease; Systemic lupus erythematosus; Renal tubular acidosis; IgA nephropathy; Cardiomyopathy; Atherosclerosis; Congenital heart defects; Aortic stenosis; Atrial septal defect (ASD); Atrioventricular (A-V) canal defect; Ductus arteriosus; Pulmonary stenosis; Subaortic stenosis; Ventricular septal defect (VSD); valve diseases; Scleroderma; fertility; Pancreatitis; Endocrine dysfunctions; Growth and reproductive disorders; Inflammatory bowel disease; Diverticular disease; Leukodystrophies; Graft vesus host; Hyperthyroidism; Endometriosis; and hematopoietic disorders.

The NOV33 nucleic acids and polypeptides are useful for detecting specific cell types. For example, expression analysis has demonstrated that a NOV33 nucleic acid is expressed in MHC II and III nervous, medulla, subthalamic nucleus, ovary, pancreas, pituitary, placenta, pons, prostate, putamen, serum, skeletal muscle, small intestine, smooth muscle (coronary artery in aortic) spinal cord, spleen, stomach, taste receptor cells of the tongue, testis, thalamus, and thymus tissue.

Additional utilities for NOV33 nucleic acids and polypeptides according to the invention are disclosed herein.

NOVX Nucleic Acids and Polypeptides

One aspect of the invention pertains to isolated nucleic acid molecules that encode NOVX polypeptides or biologically active portions thereof. Also included in the invention are nucleic acid fragments sufficient for use as hybridization probes to identify NOVX-encoding nucleic acids (e.g., NOVX mRNAs) and fragments for use as PCR primers for the amplification and/or mutation of NOVX nucleic acid molecules. As used herein, the term "nucleic acid molecule" is intended to include DNA molecules (e.g., cDNA or genomic DNA), RNA molecules (e.g., mRNA), analogs of the DNA or RNA generated using nucleotide analogs, and derivatives, fragments and homologs thereof. The nucleic acid molecule may be single-stranded or double-stranded, but preferably is comprised double-stranded DNA.

A NOVX nucleic acid can encode a mature NOVX polypeptide. As used herein, a "mature" form of a polypeptide or protein disclosed in the present invention is the product of a naturally occurring polypeptide or precursor form or proprotein. The naturally occurring polypeptide, precursor or proprotein includes, by way of nonlimiting example, the full-length gene product, encoded by the corresponding gene. Alternatively, it may be defined as the polypeptide, precursor or proprotein encoded by an ORF described herein. The product "mature" form arises, again by way of nonlimiting example, as a result of one or more naturally occurring processing steps as they may take place within the cell, or host cell, in which the gene product arises. Examples of such processing steps leading to a "mature" form of a polypeptide or protein include the cleavage of the N-terminal methionine residue encoded by the initiation codon of an ORF, or the proteolytic cleavage of a signal peptide or leader sequence. Thus a mature form arising from a precursor polypeptide or protein that has residues 1 to N, where residue 1 is the N-terminal methionine, would have residues 2 through N remaining after removal of the N-terminal methionine. Alternatively, a mature form arising from a precursor polypeptide or protein having residues 1 to N, in which an N-terminal signal sequence from residue 1 to residue M is cleaved, would have the residues from residue M+1 to residue N remaining. Further as used herein, a "mature" form of a polypeptide or protein may arise from a step of post-translational modification other than a proteolytic cleavage event. Such additional processes include, by way of non-limiting example, glycosylation, myristoylation or phosphorylation. In general, a mature polypeptide or protein may result from the operation of only one of these processes, or a combination of any of them.

The term "probes", as utilized herein, refers to nucleic acid sequences of variable length, preferably between at least about 10 nucleotides (nt), 100 nt, or as many as approximately, e.g., 6,000 nt, depending upon the specific use. Probes are used in the detection of identical, similar, or complementary nucleic acid sequences. Longer length probes are generally obtained from a natural or recombinant source, are highly specific, and much slower to hybridize than shorter length oligomer probes. Probes may be single- or double-stranded and designed to have specificity in PCR, membrane-based hybridization technologies, or ELISA-like technologies.

The term "isolated" nucleic acid molecule, as utilized herein, is one, which is separated from other nucleic acid molecules which are present in the natural source of the nucleic acid. Preferably, an "isolated" nucleic acid is free of sequences which naturally flank the nucleic acid (i.e., sequences located at the 5'- and 3'-termini of the nucleic acid) in the genomic DNA of the organism from which the nucleic acid is derived. For example, in various embodiments, the isolated NOVX nucleic acid molecules can contain less than about 5 kb, 4 kb, 3 kb, 2 kb, 1 kb, 0.5 kb or 0.1 kb of nucleotide sequences which naturally flank the nucleic acid molecule in genomic DNA of the cell/tissue from which the nucleic acid is derived (e.g., brain, heart, liver, spleen, etc.). Moreover, an "isolated" nucleic acid molecule, such as a cDNA molecule, can be substantially free of other cellular material or culture medium when produced by recombinant techniques, or of chemical precursors or other chemicals when chemically synthesized.

A nucleic acid molecule of the invention, e.g., a nucleic acid molecule having the nucleotide sequence SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 64, 66, 68, 70, 72, 74, 76, 78, 80, 82, 84, 86, 88, 90, 92, 94, 96, 98, 100, 102, 104, 106, 108, 110, 112, 114, 116, 118, 120, and 122, or a complement of this aforementioned nucleotide sequence, can be isolated using standard molecular biology techniques and the sequence information provided herein. Using all or a portion of the nucleic acid sequence of SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 64, 66, 68, 70, 72, 74, 76, 78, 80, 82, 84, 86, 88, 90, 92, 94, 96, 98, 100, 102, 104, 106, 108, 110, 112, 114, 116, 118, 120, and 122 as a hybridization probe, NOVX molecules can be isolated using standard hybridization and cloning techniques (e.g., as described in Sambrook, et al., (eds.), MOLECULAR CLONING: A LABORATORY MANUAL $2^{nd}$ Ed., Cold Spring Harbor Laboratory Press, Cold Spring Harbor, N.Y., 1989; and Ausubel, et al., (eds.), CURRENT PROTOCOLS IN MOLECULAR BIOLOGY, John Wiley & Sons, New York, N.Y., 1993.)

A nucleic acid of the invention can be amplified using cDNA, mRNA or alternatively, genomic DNA, as a template and appropriate oligonucleotide primers according to standard PCR amplification techniques. The nucleic acid so amplified can be cloned into an appropriate vector and characterized by DNA sequence analysis. Furthermore, oligonucleotides corresponding to NOVX nucleotide sequences can be prepared by standard synthetic techniques, e.g., using an automated DNA synthesizer.

As used herein, the term "oligonucleotide" refers to a series of linked nucleotide residues, which oligonucleotide has a sufficient number of nucleotide bases to be used in a PCR reaction. A short oligonucleotide sequence may be based on, or designed from, a genomic or cDNA sequence and is used to amplify, confirm, or reveal the presence of an identical, similar or complementary DNA or RNA in a particular cell or tissue. Oligonucleotides comprise portions of a nucleic acid sequence having about 10 nt, 50 nt, or 100 nt in length, preferably about 15 nt to 30 nt in length. In one embodiment of the invention, an oligonucleotide comprising a nucleic acid molecule less than 100 nt in length would further comprise at least 6 contiguous nucleotides SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 64, 66, 68, 70, 72, 74, 76, 78, 80, 82, 84, 86, 88, 90, 92, 94, 96, 98, 100, 102, 104, 106, 108, 110, 112, 114, 116, 118, 120, and 122, or a complement thereof. Oligonucleotides may be chemically synthesized and may also be used as probes.

In another embodiment, an isolated nucleic acid molecule of the invention comprises a nucleic acid molecule that is a complement of the nucleotide sequence shown in SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 64, 66, 68, 70, 72, 74, 76, 78, 80, 82, 84, 86, 88, 90, 92, 94, 96, 98, 100, 102, 104, 106, 108, 110, 112, 114, 116, 118, 120, and 122, or a portion of this nucleotide sequence (e.g., a fragment that can be used as a probe or primer or a fragment encoding a biologically-active portion of an NOVX polypeptide). A nucleic acid molecule that is complementary to the nucleotide sequence shown SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 64, 66, 68, 70, 72, 74, 76, 78, 80, 82, 84, 86, 88, 90, 92, 94, 96, 98, 100, 102, 104, 106, 108, 110, 112, 114, 116, 118, 120, and 122 is one that is sufficiently complementary to the nucleotide sequence shown SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 64, 66, 68, 70, 72, 74, 76, 78, 80, 82, 84, 86, 88, 90, 92, 94, 96, 98, 100, 102, 104, 106, 108, 110, 112, 114, 116, 118, 120, and 122 that it can hydrogen bond with little or no mismatches to the nucleotide sequence shown SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 64, 66, 68, 70, 72, 74, 76, 78, 80, 82, 84, 86, 88, 90, 92, 94, 96, 98, 100, 102, 104, 106, 108, 110, 112, 114, 116, 118, 120, and 122 thereby forming a stable duplex.

As used herein, the term "complementary" refers to Watson-Crick or Hoogsteen base pairing between nucleotides units of a nucleic acid molecule, and the term "binding" means the physical or chemical interaction between two polypeptides or compounds or associated polypeptides or compounds or combinations thereof. Binding includes ionic, non-ionic, van der Waals, hydrophobic interactions, and the like. A physical interaction can be either direct or indirect. Indirect interactions may be through or due to the effects of another polypeptide or compound. Direct binding refers to interactions that do not take place through, or due to, the effect of another polypeptide or compound, but instead are without other substantial chemical intermediates.

Fragments provided herein are defined as sequences of at least 6 (contiguous) nucleic acids or at least 4 (contiguous) amino acids, a length sufficient to allow for specific hybridization in the case of nucleic acids or for specific recognition of an epitope in the case of amino acids, respectively, and are at most some portion less than a full length sequence. Fragments may be derived from any contiguous portion of a nucleic acid or amino acid sequence of choice. Derivatives are nucleic acid sequences or amino acid sequences formed from the native compounds either directly or by modification or partial substitution. Analogs are nucleic acid sequences or amino acid sequences that have a structure similar to, but not identical to, the native compound but differs from it in respect to certain components or side chains. Analogs may be synthetic or from a different evolutionary origin and may have a similar or opposite metabolic activity compared to wild type. Homologs are nucleic acid sequences or amino acid sequences of a particular gene that are derived from different species.

Derivatives and analogs may be full length or other than full length, if the derivative or analog contains a modified nucleic acid or amino acid, as described below. Derivatives or analogs of the nucleic acids or proteins of the invention include, but are not limited to, molecules comprising regions that are substantially homologous to the nucleic acids or proteins of the invention, in various embodiments, by at least about 70%, 80%, or 95% identity (with a preferred identity of 80–95%) over a nucleic acid or amino acid sequence of identical size or when compared to an aligned sequence in which the alignment is done by a computer homology program known in the art, or whose encoding nucleic acid is capable of hybridizing to the complement of a sequence encoding the aforementioned proteins under stringent, moderately stringent, or low stringent conditions. See e.g. Ausubel, et al., CURRENT PROTOCOLS IN MOLECULAR BIOLOGY, John Wiley & Sons, New York, N.Y., 1993, and below.

A "homologous nucleic acid sequence" or "homologous amino acid sequence," or variations thereof, refer to sequences characterized by a homology at the nucleotide level or amino acid level as discussed above. Homologous nucleotide sequences encode those sequences coding for isoforms of NOVX polypeptides. Isoforms can be expressed in different tissues of the same organism as a result of, for example, alternative splicing of RNA. Alternatively, isoforms can be encoded by different genes. In the invention, homologous nucleotide sequences include nucleotide sequences encoding for an NOVX polypeptide of species other than humans, including, but not limited to: vertebrates, and thus can include, e.g., frog, mouse, rat, rabbit, dog, cat cow, horse, and other organisms. Homologous nucleotide sequences also include, but are not limited to, naturally occurring allelic variations and mutations of the nucleotide sequences set forth herein. A homologous nucleotide sequence does not, however, include the exact nucleotide sequence encoding human NOVX protein. Homologous nucleic acid sequences include those nucleic acid sequences that encode conservative amino acid substitutions (see below) in SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 64, 66, 68, 70, 72, 74, 76, 78, 80, 82, 84, 86, 88, 90, 92, 94, 96, 98, 100, 102, 104, 106, 108, 110, 112, 114, 116, 118, 120, and 122, as well as a polypeptide possessing NOVX biological activity. Various biological activities of the NOVX proteins are described below.

An NOVX polypeptide is encoded by the open reading frame ("ORF") of an NOVX nucleic acid. An ORF corresponds to a nucleotide sequence that could potentially be translated into a polypeptide. A stretch of nucleic acids comprising an ORF is uninterrupted by a stop codon. An ORF that represents the coding sequence for a full protein begins with an ATG "start" codon and terminates with one of the three "stop" codons, namely, TAA, TAG, or TGA. For the purposes of this invention, an ORF may be any part of a coding sequence, with or without a start codon, a stop codon, or both. For an ORF to be considered as a good candidate for coding for a bona fide cellular protein, a minimum size requirement is often set, e.g., a stretch of DNA that would encode a protein of 50 amino acids or more.

The nucleotide sequences determined from the cloning of the human NOVX genes allows for the generation of probes and primers designed for use in identifying and/or cloning NOVX homologues in other cell types, e.g. from other tissues, as well as NOVX homologues from other vertebrates. The probe/primer typically comprises substantially purified oligonucleotide. The oligonucleotide typically comprises a region of nucleotide sequence that hybridizes under stringent conditions to at least about 12, 25, 50, 100, 150, 200, 250, 300, 350 or 400 consecutive sense strand nucleotide sequence SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 64, 66, 68, 70, 72, 74, 76, 78, 80, 82, 84, 86, 88, 90, 92, 94, 96, 98, 100, 102, 104, 106, 108, 110, 112, 114, 116, 118, 120, and 122; or an anti-sense strand nucleotide sequence of SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 64, 66, 68, 70, 72, 74, 76, 78, 80, 82, 84, 86, 88, 90, 92, 94, 96, 98, 100, 102, 104, 106, 108, 110, 112, 114, 116, 118, 120, and 122; or of a naturally occurring mutant of SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 64, 66, 68, 70, 72, 74, 76, 78, 80, 82, 84, 86, 88, 90, 92, 94, 96, 98, 100, 102, 104, 106, 108, 110, 112, 114, 116, 118, 120, and 122.

Probes based on the human NOVX nucleotide sequences can be used to detect transcripts or genomic sequences encoding the same or homologous proteins. In various embodiments, the probe further comprises a label group attached thereto, e.g. the label group can be a radioisotope, a fluorescent compound, an enzyme, or an enzyme co-factor. Such probes can be used as a part of a diagnostic test kit for identifying cells or tissues which mis-express an NOVX protein, such as by measuring a level of an NOVX-encoding nucleic acid in a sample of cells from a subject e.g., detecting NOVX mRNA levels or determining whether a genomic NOVX gene has been mutated or deleted.

"A polypeptide having a biologically-active portion of an NOVX polypeptide" refers to polypeptides exhibiting activity similar, but not necessarily identical to, an activity of a polypeptide of the invention, including mature forms, as measured in a particular biological assay, with or without dose dependency. A nucleic acid fragment encoding a "biologically active portion of NOVX" can be prepared by isolating a portion SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 64, 66, 68, 70, 72, 74, 76, 78, 80, 82, 84, 86, 88, 90, 92, 94, 96, 98, 100, 102, 104, 106, 108, 110, 112, 114, 116, 118, 120, and 122, that encodes a polypeptide having an NOVX biological activity (the biological activities of the NOVX proteins are described below), expressing the encoded portion of NOVX protein (e.g., by recombinant expression in vitro) and assessing the activity of the encoded portion of NOVX.

NOVX Nucleic Acid and Polypeptide Variants

The invention further encompasses nucleic acid molecules that differ from the nucleotide sequences shown in SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 64, 66, 68, 70, 72, 74, 76, 78, 80, 82, 84, 86, 88, 90, 92, 94, 96, 98, 100, 102, 104, 106, 108, 110, 112, 114, 116, 118, 120, and 122 due to degeneracy of the genetic code and thus encode the same NOVX proteins as that encoded by the nucleotide sequences shown in SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 64, 66, 68, 70, 72, 74, 76, 78, 80, 82, 84, 86, 88, 90, 92, 94, 96, 98, 100, 102, 104, 106, 108, 110, 112, 114, 116, 118, 120, and 122. In another embodiment, an isolated nucleic acid molecule of the invention has a nucleotide sequence encoding a protein having an amino acid sequence shown in SEQ ID NOS:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 65, 67, 69, 71, 73, 75, 77, 79, 81, 83, 85, 87, 89, 91, 93, 95, 97, 99, 101, 103, 105, 107, 109, 111, 113, 115, 117, 119, 121, and 123.

In addition to the human NOVX nucleotide sequences shown in SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 64, 66, 68, 70, 72, 74, 76, 78, 80, 82, 84, 86, 88, 90, 92, 94, 96, 98, 100, 102, 104, 106, 108, 110, 112, 114, 116, 118, 120, and 122, it will be appreciated by those skilled in the art that DNA sequence polymorphisms that lead to changes in the amino acid sequences of the NOVX polypeptides may exist within a population (e.g., the human population). Such genetic polymorphism in the NOVX genes may exist among individuals within a population due to natural allelic variation. As used herein, the terms "gene" and "recombinant gene" refer to nucleic acid molecules comprising an open reading frame (ORF) encoding an NOVX protein, preferably a vertebrate NOVX protein. Such natural allelic variations can typically result in 1–5% variance in the nucleotide sequence of the NOVX genes. Any and all such nucleotide variations and resulting amino acid polymorphisms in the NOVX polypeptides, which are the result of natural allelic variation and that do not alter the functional activity of the NOVX polypeptides, are intended to be within the scope of the invention.

Moreover, nucleic acid molecules encoding NOVX proteins from other species, and thus that have a nucleotide sequence that differs from the human SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 64, 66, 68, 70, 72, 74, 76, 78, 80, 82, 84, 86, 88, 90, 92, 94, 96, 98, 100, 102, 104, 106, 108, 110, 112, 114, 116, 118, 120, and 122 are intended to be within the scope of the invention. Nucleic acid molecules corresponding to natural allelic variants and homologues of the NOVX cDNAs of the invention can be isolated based on their homology to the human NOVX nucleic acids disclosed herein using the human cDNAs, or a portion thereof, as a hybridization probe according to standard hybridization techniques under stringent hybridization conditions.

Accordingly, in another embodiment, an isolated nucleic acid molecule of the invention is at least 6 nucleotides in length and hybridizes under stringent conditions to the nucleic acid molecule comprising the nucleotide sequence of SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 64, 66, 68, 70, 72, 74, 76, 78, 80, 82, 84, 86, 88, 90, 92, 94, 96, 98, 100, 102, 104, 106, 108, 110, 112, 114, 116, 118, 120, and 122. In another embodiment, the nucleic acid is at least 10, 25, 50, 100, 250, 500, 750, 1000, 1500, or 2000 or more nucleotides in length. In yet another embodiment, an isolated nucleic acid molecule of the invention hybridizes to the coding region. As used herein, the term "hybridizes under stringent conditions" is intended to describe conditions for hybridization and washing under which nucleotide sequences at least 60% homologous to each other typically remain hybridized to each other.

Homologs (i.e., nucleic acids encoding NOVX proteins derived from species other than human) or other related sequences (e.g., paralogs) can be obtained by low, moderate or high stringency hybridization with all or a portion of the particular human sequence as a probe using methods well known in the art for nucleic acid hybridization and cloning.

As used herein, the phrase "stringent hybridization conditions" refers to conditions under which a probe, primer or oligonucleotide will hybridize to its target sequence, but to no other sequences. Stringent conditions are sequence-dependent and will be different in different circumstances. Longer sequences hybridize specifically at higher temperatures than shorter sequences. Generally, stringent conditions are selected to be about 5° C. lower than the thermal melting point (Tm) for the specific sequence at a defined ionic strength and pH. The Tm is the temperature (under defined ionic strength, pH and nucleic acid concentration) at which 50% of the probes complementary to the target sequence hybridize to the target sequence at equilibrium. Since the target sequences are generally present at excess, at Tm, 50% of the probes are occupied at equilibrium. Typically, stringent conditions will be those in which the salt concentration is less than about 1.0 M sodium ion, typically about 0.01 to 1.0 M sodium ion (or other salts) at pH 7.0 to 8.3 and the temperature is at least about 30° C. for short probes, primers or oligonucleotides (e.g., 10 nt to 50 nt) and at least about 60° C. for longer probes, primers and oligonucleotides. Stringent conditions may also be achieved with the addition of destabilizing agents, such as formamide.

Stringent conditions are known to those skilled in the art and can be found in Ausubel, et al., (eds.), CURRENT PROTOCOLS IN MOLECULAR BIOLOGY, John Wiley & Sons, N.Y. (1989), 6.3.1–6.3.6. Preferably, the conditions are such that sequences at least about 65%, 70%, 75%, 85%, 90%, 95%, 98%, or 99% homologous to each other typically remain hybridized to each other. A non-limiting example of stringent hybridization conditions are hybridization in a high salt buffer comprising 6×SSC, 50 mM Tris-HCl (pH 7.5), 1 mM EDTA, 0.02% PVP, 0.02% Ficoll, 0.02% BSA, and 500 mg/ml denatured salmon sperm DNA at 65° C., followed by one or more washes in 0.2×SSC, 0.01% BSA at 50° C. An isolated nucleic acid molecule of the invention that hybridizes under stringent conditions to the sequences SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 64, 66, 68, 70, 72, 74, 76, 78, 80, 82, 84, 86, 88, 90, 92, 94, 96, 98, 100, 102, 104, 106, 108, 110, 112, 114, 116, 118, 120, and 122, corresponds to a naturally-occurring nucleic acid molecule. As used herein, a "naturally-occurring" nucleic acid molecule refers to an RNA or DNA molecule having a nucleotide sequence that occurs in nature (e.g., encodes a natural protein).

In a second embodiment, a nucleic acid sequence that is hybridizable to the nucleic acid molecule comprising the nucleotide sequence of SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 64, 66, 68, 70, 72, 74, 76, 78, 80, 82, 84, 86, 88, 90, 92, 94, 96, 98, 100, 102, 104, 106, 108, 110, 112, 114, 116, 118, 120, and 122, or fragments, analogs or derivatives thereof, under conditions of moderate stringency is provided. A non-limiting example of moderate stringency hybridization conditions are hybridization in 6×SSC, 5× Denhardt's solution, 0.5% SDS and 100 mg/ml denatured salmon sperm DNA at 55° C., followed by one or more washes in 1×SSC, 0.1% SDS at 37° C. Other conditions of moderate stringency that may be used are well-known within the art. See, e.g., Ausubel, et al. (eds.), 1993, CURRENT PROTOCOLS IN MOLECULAR BIOLOGY, John Wiley & Sons, NY, and Kriegler, 1990; GENE TRANSFER AND EXPRESSION, A LABORATORY MANUAL, Stockton Press, NY.

In a third embodiment, a nucleic acid that is hybridizable to the nucleic acid molecule comprising the nucleotide sequences SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 64, 66, 68, 70, 72, 74, 76, 78, 80, 82, 84, 86, 88, 90, 92, 94, 96, 98, 100, 102, 104, 106, 108, 110, 112, 114, 116, 118, 120, and 122, or fragments, analogs or derivatives thereof, under conditions of low stringency, is provided. A non-limiting example of low stringency hybridization conditions are hybridization in 35% formamide, 5×SSC, 50 mM Tris-HCl (pH 7.5), 5 mM EDTA, 0.02% PVP, 0.02% Ficoll, 0.2% BSA, 100 mg/ml denatured salmon sperm DNA, 10% (wt/vol) dextran sulfate at 40° C., followed by one or more washes in 2×SSC, 25 mM Tris-HCl (pH 7.4), 5 mM EDTA, and 0.1% SDS at 50° C. Other conditions of low stringency that may be used are well known in the art (e.g., as employed for cross-species hybridizations). See, e.g., Ausubel, et al. (eds.), 1993, CURRENT PROTOCOLS IN MOLECULAR BIOLOGY, John Wiley & Sons, NY, and Kriegler, 1990, GENE TRANSFER AND EXPRESSION, A LABORATORY MANUAL, Stockton Press, NY; Shilo and Weinberg, 1981. *Proc Natl Acad Sci USA* 78: 6789–6792.

Conservative Mutations

In addition to naturally-occurring allelic variants of NOVX sequences that may exist in the population, the skilled artisan will further appreciate that changes can be introduced by mutation into the nucleotide sequences SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 64, 66, 68, 70, 72, 74, 76, 78, 80, 82, 84, 86, 88, 90, 92, 94, 96, 98, 100, 102, 104, 106, 108, 110, 112, 114, 116, 118, 120, and 122, thereby leading to changes in the amino acid sequences of the encoded NOVX proteins, without altering the functional ability of said NOVX proteins. For example, nucleotide substitutions leading to amino acid substitutions at "non-essential" amino acid residues can be made in the sequence SEQ ID NOS:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 65, 67, 69, 71, 73, 75, 77, 79, 81, 83, 85, 87, 89, 91, 93, 95, 97, 99, 101, 103, 105, 107, 109, 111, 113, 115, 117, 119, 121, and 123. A "non-essential" amino acid residue is a residue that can be altered from the wild-type sequences of the NOVX proteins without altering their biological activity, whereas an "essential" amino acid residue is required for such biological activity. For example, amino acid residues that are conserved among the NOVX proteins of the invention are predicted to be particularly non-amenable to alteration. Amino acids for which conservative substitutions can be made are well-known within the art.

Another aspect of the invention pertains to nucleic acid molecules encoding NOVX proteins that contain changes in amino acid residues that are not essential for activity. Such NOVX proteins differ in amino acid sequence from SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 64, 66, 68, 70, 72, 74, 76, 78, 80, 82, 84, 86, 88, 90, 92, 94, 96, 98, 100, 102, 104, 106, 108, 110, 112, 114, 116, 118, 120, and 122 yet retain biological activity. In one embodiment, the isolated nucleic acid molecule comprises a nucleotide sequence encoding a protein, wherein the protein comprises an amino acid sequence at least about 45% homologous to the amino acid sequences SEQ ID NOS:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 65, 67, 69, 71, 73, 75, 77, 79, 81, 83, 85, 87, 89, 91, 93, 95, 97, 99, 101, 103, 105, 107, 109, 111, 113, 115, 117, 119, 121, and 123. Preferably, the protein encoded by the nucleic acid molecule is at least about 60% homologous to SEQ ID NOS:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 65, 67, 69, 71, 73, 75, 77, 79, 81, 83, 85, 87, 89, 91, 93, 95, 97, 99, 101, 103, 105, 107, 109, 111, 113, 115, 117, 119, 121, and 123; more preferably at least about 70% homologous SEQ ID NOS:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 65, 67, 69, 71, 73, 75, 77, 79, 81, 83, 85, 87, 89, 91, 93, 95, 97, 99, 101, 103, 105, 107, 109, 111, 113, 115, 117, 119, 121, and 123; still more preferably at least about 80% homologous to SEQ ID NOS:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 65, 67, 69, 71, 73, 75, 77, 79, 81, 83, 85, 87, 89, 91, 93, 95, 97, 99, 101, 103, 105, 107, 109, 111, 113, 115, 117, 119, 121, and 123; even more preferably at least about 90% homologous to SEQ ID NOS:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 65, 67, 69, 71, 73, 75, 77, 79, 81, 83, 85, 87, 89, 91, 93, 95, 97, 99, 101, 103, 105, 107, 109, 111, 113, 115, 117, 119, 121, and 123; and most preferably at least about 95% homologous to SEQ ID NOS:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 65, 67, 69, 71, 73, 75, 77, 79, 81, 83, 85, 87, 89, 91, 93, 95, 97, 99, 101, 103, 105, 107, 109, 111, 113, 115, 117, 119, 121, and 123.

An isolated nucleic acid molecule encoding an NOVX protein homologous to the protein of SEQ ID NOS:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 65, 67, 69, 71, 73, 75, 77, 79, 81, 83, 85, 87, 89, 91, 93, 95, 97, 99, 101, 103, 105, 107, 109, 111, 113, 115, 117, 119, 121, and 123 can be created by introducing one or more nucleotide substitutions, additions or deletions into the nucleotide sequence of SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 64, 66, 68, 70, 72, 74, 76, 78, 80, 82, 84, 86, 88, 90, 92, 94, 96, 98, 100, 102, 104, 106, 108, 110, 112, 114, 116, 118, 120, and 122, such that one or more amino acid substitutions, additions or deletions are introduced into the encoded protein.

Mutations can be introduced into SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 64, 66, 68, 70, 72, 74, 76, 78, 80, 82, 84, 86, 88, 90, 92, 94, 96, 98, 100, 102, 104, 106, 108, 110, 112, 114, 116, 118, 120, and 122 by standard techniques, such as site-directed mutagenesis and PCR-mediated mutagenesis. Preferably, conservative amino acid substitutions are made at one or more predicted, non-essential amino acid residues. A "conservative amino acid substitution" is one in which the amino acid residue is replaced with an amino acid residue having a similar side chain. Families of amino acid residues having similar side chains have been defined within the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Thus, a predicted non-essential amino acid residue in the NOVX protein is replaced with another amino acid residue from the same side chain family. Alternatively, in another embodiment, mutations can be introduced randomly along all or part of an NOVX coding sequence, such as by saturation mutagenesis, and the resultant mutants can be screened for NOVX biological activity to identify mutants that retain activity. Following mutagenesis SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 64, 66, 68, 70, 72, 74, 76, 78, 80, 82, 84, 86, 88, 90, 92, 94, 96, 98, 100, 102, 104, 106, 108, 110, 112, 114, 116, 118, 120, and 122, the encoded protein can be expressed by any recombinant technology known in the art and the activity of the protein can be determined.

The relatedness of amino acid families may also be determined based on side chain interactions. Substituted amino acids may be fully conserved "strong" residues or fully conserved "weak" residues. The "strong" group of conserved amino acid residues may be any one of the following groups: STA, NEQK, NHQK, NDEQ, QHRK, MILV, MILF, HY, FYW, wherein the single letter amino acid codes are grouped by those amino acids that may be substituted for each other. Likewise, the "weak" group of conserved residues may be any one of the following: CSA, ATV, SAG, STNK, STPA, SGND, SNDEQK, NDEQHK, NEQHRK, VLIM, HFY, wherein the letters within each group represent the single letter amino acid code.

In one embodiment, a mutant NOVX protein can be assayed for (i) the ability to form protein:protein interactions with other NOVX proteins, other cell-surface proteins, or biologically-active portions thereof, (ii) complex formation between a mutant NOVX protein and an NOVX ligand; or (iii) the ability of a mutant NOVX protein to bind to an intracellular target protein or biologically-active portion thereof; (e.g. avidin proteins).

In yet another embodiment, a mutant NOVX protein can be assayed for the ability to regulate a specific biological function (e.g., regulation of insulin release).

Antisense Nucleic Acids

Another aspect of the invention pertains to isolated antisense nucleic acid molecules that are hybridizable to or complementary to the nucleic acid molecule comprising the nucleotide sequence of SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 64, 66, 68, 70, 72, 74, 76, 78, 80, 82, 84, 86, 88, 90, 92, 94, 96, 98, 100, 102, 104, 106, 108, 110, 112, 114, 116, 118, 120, and 122, or fragments, analogs or derivatives thereof. An "antisense" nucleic acid comprises a nucleotide sequence that is complementary to a "sense" nucleic acid encoding a protein (e.g., complementary to the coding strand of a double-stranded cDNA molecule or complementary to an mRNA sequence). In specific aspects, antisense nucleic acid molecules are provided that comprise a sequence complementary to at least about 10, 25, 50, 100, 250 or 500 nucleotides or an entire NOVX coding strand, or to only a portion thereof. Nucleic acid molecules encoding fragments, homologs, derivatives and analogs of an NOVX protein of SEQ ID NOS:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 65, 67, 69, 71, 73, 75, 77, 79, 81, 83, 85, 87, 89, 91, 93, 95, 97, 99, 101, 103, 105, 107, 109, 111, 113, 115, 117, 119, 121, and 123, or antisense nucleic acids complementary to an NOVX nucleic acid sequence of SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 64, 66, 68, 70, 72, 74, 76, 78, 80, 82, 84, 86, 88, 90, 92, 94, 96, 98, 100, 102, 104, 106, 108, 110, 112, 114, 116, 118, 120, and 122, are additionally provided.

In one embodiment, an antisense nucleic acid molecule is antisense to a "coding region" of the coding strand of a nucleotide sequence encoding an NOVX protein. The term "coding region" refers to the region of the nucleotide sequence comprising codons which are translated into amino acid residues. In another embodiment, the antisense nucleic acid molecule is antisense to a "noncoding region" of the coding strand of a nucleotide sequence encoding the NOVX protein. The term "noncoding region" refers to 5' and 3' sequences which flank the coding region that are not translated into amino acids (i.e., also referred to as 5' and 3' untranslated regions).

Given the coding strand sequences encoding the NOVX protein disclosed herein, antisense nucleic acids of the invention can be designed according to the rules of Watson and Crick or Hoogsteen base pairing. The antisense nucleic acid molecule can be complementary to the entire coding region of NOVX mRNA, but more preferably is an oligonucleotide that is antisense to only a portion of the coding or noncoding region of NOVX mRNA. For example, the antisense oligonucleotide can be complementary to the region surrounding the translation start site of NOVX mRNA. An antisense oligonucleotide can be, for example, about 5, 10, 15, 20, 25, 30, 35, 40, 45 or 50 nucleotides in length. An antisense nucleic acid of the invention can be constructed using chemical synthesis or enzymatic ligation reactions using procedures known in the art. For example, an antisense nucleic acid (e.g., an antisense oligonucleotide) can be chemically synthesized using naturally-occurring nucleotides or variously modified nucleotides designed to increase the biological stability of the molecules or to increase the physical stability of the duplex formed between the antisense and sense nucleic acids (e.g., phosphorothioate derivatives and acridine substituted nucleotides can be used).

Examples of modified nucleotides that can be used to generate the antisense nucleic acid include: 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethylaminomethyl-2-thiouridine, 5-carboxymethylaminomethyluracil, dihydrouracil, beta-D-galactosylqueosine, inosine, N-6-isopentenyladenine, 1-methylguanine, 1-methylinosine, 2,2-dimethylguanine, 2-methyladenine, 2-methylguanine, 3-methylcytosine, 5-methylcytosine, N-6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N-6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl) uracil, (acp3)w, and 2,6-diaminopurine. Alternatively, the antisense nucleic acid can be produced biologically using an expression vector into which a nucleic acid has been subcloned in an antisense orientation (i.e., RNA transcribed from the inserted nucleic acid will be of an antisense orientation to a target nucleic acid of interest, described further in the following subsection).

The antisense nucleic acid molecules of the invention are typically administered to a subject or generated in situ such that they hybridize with or bind to cellular mRNA and/or genomic DNA encoding an NOVX protein to thereby inhibit expression of the protein (e.g., by inhibiting transcription and/or translation). The hybridization can be by conventional nucleotide complementarity to form a stable duplex, or, for example, in the case of an antisense nucleic acid molecule that binds to DNA duplexes, through specific interactions in the major groove of the double helix. An example of a route of administration of antisense nucleic acid molecules of the invention includes direct injection at a tissue site. Alternatively, antisense nucleic acid molecules can be modified to target selected cells and then administered systemically. For example, for systemic administration, antisense molecules can be modified such that they specifically bind to receptors or antigens expressed on a selected cell surface (e.g., by linking the antisense nucleic acid molecules to peptides or antibodies that bind to cell surface receptors or antigens). The antisense nucleic acid molecules can also be delivered to cells using the vectors described herein. To achieve sufficient nucleic acid molecules, vector constructs in which the antisense nucleic acid molecule is placed under the control of a strong pol II or pol III promoter are preferred.

In yet another embodiment, the antisense nucleic acid molecule of the invention is an α-anomeric nucleic acid molecule. An c-anomeric nucleic acid molecule forms specific double-stranded hybrids with complementary RNA in which, contrary to the usual β-units, the strands run parallel to each other. See, e.g., Gaultier, et al., 1987. *Nucl. Acids Res.* 15: 6625–6641. The antisense nucleic acid molecule can also comprise a 2'-o-methylribonucleotide (See, e.g., Inoue, et al. 1987. *Nucl. Acids Res.* 15: 6131–6148) or a chimeric RNA-DNA analogue (See, e.g., Inoue, et al., 1987. *FEBS Lett.* 215: 327–330).

Ribozymes and PNA Moieties

Nucleic acid modifications include, by way of non-limiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject.

In one embodiment, an antisense nucleic acid of the invention is a ribozyme. Ribozymes are catalytic RNA molecules with ribonuclease activity that are capable of cleaving a single-stranded nucleic acid, such as an mRNA, to which they have a complementary region. Thus, ribozymes (e.g., hammerhead ribozymes as described in Haselhoff and Gerlach 1988. *Nature* 334: 585–591) can be used to catalytically cleave NOVX mRNA transcripts to thereby inhibit translation of NOVX mRNA. A ribozyme having specificity for an NOVX-encoding nucleic acid can be designed based upon the nucleotide sequence of an NOVX cDNA disclosed herein (i.e., SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 64, 66, 68, 70, 72, 74, 76, 78, 80, 82, 84, 86, 88, 90, 92, 94, 96, 98, 100, 102, 104, 106, 108, 110, 112, 114, 116, 118, 120, and 122). For example, a derivative of a Tetrahymena L-19 IVS RNA can be constructed in which the nucleotide sequence of the active site is complementary to the nucleotide sequence to be cleaved in an NOVX-encoding mRNA. See, e.g., U.S. Pat. No. 4,987,071 to Cech, et al. and U.S. Pat. No. 5,116,742 to Cech, et al. NOVX mRNA can also be used to select a catalytic RNA having a specific ribonuclease activity from a pool of RNA molecules. See, e.g., Bartel et al., (1993) *Science* 261:1411–1418.

Alternatively, NOVX gene expression can be inhibited by targeting nucleotide sequences complementary to the regulatory region of the NOVX nucleic acid (e.g., the NOVX promoter and/or enhancers) to form triple helical structures that prevent transcription of the NOVX gene in target cells. See, e.g., Helene, 1991. *Anticancer Drug Des.* 6: 569–84; Helene, et al. 1992. *Ann. N.Y. Acad. Sci.* 660: 27–36; Maher, 1992. *Bioassays* 14: 807–15.

In various embodiments, the NOVX nucleic acids can be modified at the base moiety, sugar moiety or phosphate backbone to improve, e.g., the stability, hybridization, or solubility of the molecule. For example, the deoxyribose phosphate backbone of the nucleic acids can be modified to generate peptide nucleic acids. See, e.g., Hyrup, et al., 1996. *Bioorg Med Chem* 4: 5–23. As used herein, the terms "peptide nucleic acids" or "PNAs" refer to nucleic acid mimics (e.g., DNA mimics) in which the deoxyribose phosphate backbone is replaced by a pseudopeptide backbone and only the four natural nucleobases are retained. The neutral backbone of PNAs has been shown to allow for specific hybridization to DNA and RNA under conditions of low ionic strength. The synthesis of PNA oligomers can be performed using standard solid phase peptide synthesis protocols as described in Hyrup, et al., 1996. supra; Perry-O'Keefe, et al., 1996. *Proc. Natl. Acad. Sci. USA* 93: 14670–14675.

PNAs of NOVX can be used in therapeutic and diagnostic applications. For example, PNAs can be used as antisense or antigene agents for sequence-specific modulation of gene expression by, e.g., inducing transcription or translation arrest or inhibiting replication. PNAs of NOVX can also be used, for example, in the analysis of single base pair mutations in a gene (e.g., PNA directed PCR clamping; as artificial restriction enzymes when used in combination with other enzymes, e.g., $S_1$ nucleases (See, Hyrup, et al., 1996.supra); or as probes or primers for DNA sequence and hybridization (See, Hyrup, et al., 1996, supra; Perry-O'Keefe, et al., 1996. supra).

In another embodiment, PNAs of NOVX can be modified, e.g., to enhance their stability or cellular uptake, by attaching lipophilic or other helper groups to PNA, by the formation of PNA-DNA chimeras, or by the use of liposomes or other techniques of drug delivery known in the art. For example, PNA-DNA chimeras of NOVX can be generated that may combine the advantageous properties of PNA and DNA. Such chimeras allow DNA recognition enzymes (e.g., RNase H and DNA polymerases) to interact with the DNA portion while the PNA portion would provide high binding affinity and specificity. PNA-DNA chimeras can be linked using linkers of appropriate lengths selected in terms of base stacking, number of bonds between the nucleobases, and orientation (see, Hyrup, et al., 1996. supra). The synthesis of PNA-DNA chimeras can be performed as described in Hyrup, et al., 1996. supra and Finn, et al., 1996. *Nucl Acids Res* 24: 3357–3363. For example, a DNA chain can be synthesized on a solid support using standard phosphoramidite coupling chemistry, and modified nucleoside analogs, e.g., 5'-(4-methoxytrityl)amino-5'-deoxy-thymidine phosphoramidite, can be used between the PNA and the 5' end of DNA. See, e.g., Mag, et al., 1989. *Nucl Acid Res* 17: 5973–5988. PNA monomers are then coupled in a stepwise manner to produce a chimeric molecule with a 5' PNA segment and a 3' DNA segment. See, e.g., Finn, et al., 1996. supra. Alternatively, chimeric molecules can be synthesized with a 5' DNA segment and a 3' PNA segment. See, e.g., Petersen, et al., 1975. *Bioorg. Med. Chem. Lett.* 5: 1119–11124.

In other embodiments, the oligonucleotide may include other appended groups such as peptides (e.g., for targeting host cell receptors in vivo), or agents facilitating transport across the cell membrane (see, e.g., Letsinger, et al., 1989. *Proc. Natl. Acad. Sci. U.S.A.* 86: 6553–6556; Lemaitre, et al., 1987. *Proc. Natl. Acad. Sci.* 84: 648–652; PCT Publication No. WO88/09810) or the blood-brain barrier (see, e.g., PCT Publication No. WO 89/10134). In addition, oligonucleotides can be modified with hybridization triggered cleavage agents (see, e.g. Krol, et al., 1988. *BioTechniques* 6:958–976) or intercalating agents (see, e.g., Zon, 1988. Pharm. Res. 5: 539–549). To this end, the oligonucleotide may be conjugated to another molecule, e.g. a peptide, a hybridization triggered cross-linking agent, a transport agent, a hybridization-triggered cleavage agent, and the like.

NOVX Polypeptides

A polypeptide according to the invention includes a polypeptide including the amino acid sequence of NOVX polypeptides whose sequences are provided in SEQ ID NOS:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 65, 67, 69, 71, 73, 75, 77, 79, 81, 83, 85, 87, 89, 91, 93, 95, 97, 99, 101, 103, 105, 107, 109, 111, 113, 115, 117, 119, 121, and 123. The invention also includes a mutant or variant protein any of whose residues may be changed from the corresponding residues shown in SEQ ID NOS:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 65, 67, 69, 71, 73, 75, 77, 79, 81, 83, 85, 87, 89, 91, 93, 95, 97, 99, 101, 103, 105, 107, 109, 111, 113, 115, 117, 119, 121, and 123 while still encoding a protein that maintains its NOVX activities and physiological functions, or a functional fragment thereof.

In general, an NOVX variant that preserves NOVX-like function includes any variant in which residues at a particular position in the sequence have been substituted by other amino acids, and further include the possibility of inserting an additional residue or residues between two residues of the parent protein as well as the possibility of deleting one or more residues from the parent sequence. Any amino acid substitution, insertion, or deletion is encompassed by the invention. In favorable circumstances, the substitution is a conservative substitution as defined above.

One aspect of the invention pertains to isolated NOVX proteins, and biologically-active portions thereof, or derivatives, fragments, analogs or homologs thereof. Also provided are polypeptide fragments suitable for use as immunogens to raise anti-NOVX antibodies. In one embodiment, native NOVX proteins can be isolated from cells or tissue sources by an appropriate purification scheme using standard protein purification techniques. In another embodiment, NOVX proteins are produced by recombinant DNA techniques. Alternative to recombinant expression, an NOVX protein or polypeptide can be synthesized chemically using standard peptide synthesis techniques.

An "isolated" or "purified" polypeptide or protein or biologically-active portion thereof is substantially free of cellular material or other contaminating proteins from the cell or tissue source from which the NOVX protein is derived, or substantially free from chemical precursors or other chemicals when chemically synthesized. The language "substantially free of cellular material" includes preparations of NOVX proteins in which the protein is separated from cellular components of the cells from which it is isolated or recombinantly-produced. In one embodiment, the language "substantially free of cellular material" includes preparations of NOVX proteins having less than about 30% (by dry weight) of non-NOVX proteins (also referred to herein as a "contaminating protein"), more preferably less than about 20% of non-NOVX proteins, still more preferably less than about 10% of non-NOVX proteins, and most preferably less than about 5% of non-NOVX proteins. When the NOVX protein or biologically-active portion thereof is recombinantly-produced, it is also preferably substantially free of culture medium, i.e., culture medium represents less than about 20%, more preferably less than about 10%, and most preferably less than about 5% of the volume of the NOVX protein preparation.

The language "substantially free of chemical precursors or other chemicals" includes preparations of NOVX proteins in which the protein is separated from chemical precursors or other chemicals that are involved in the synthesis of the protein. In one embodiment, the language "substantially free of chemical precursors or other chemicals" includes preparations of NOVX proteins having less than about 30% (by dry weight) of chemical precursors or non-NOVX chemicals, more preferably less than about 20% chemical precursors or non-NOVX chemicals, still more preferably less than about 10% chemical precursors or non-NOVX chemicals, and most preferably less than about 5% chemical precursors or non-NOVX chemicals.

Biologically-active portions of NOVX proteins include peptides comprising amino acid sequences sufficiently homologous to or derived from the amino acid sequences of the NOVX proteins (e.g., the amino acid sequence shown in SEQ ID NOS:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 65, 67, 69, 71, 73, 75, 77, 79, 81, 83, 85, 87, 89, 91, 93, 95, 97, 99, 101, 103, 105, 107, 109, 111, 113, 115, 117, 119, 121, and 123) that include fewer amino acids than the full-length NOVX proteins, and exhibit at least one activity of an NOVX protein. Typically, biologically-active portions comprise a domain or motif with at least one activity of the NOVX protein. A biologically-active portion of an NOVX protein can be a polypeptide which is, for example, 10, 25, 50, 100 or more amino acid residues in length.

Moreover, other biologically-active portions, in which other regions of the protein are deleted, can be prepared by recombinant techniques and evaluated for one or more of the functional activities of a native NOVX protein.

In an embodiment, the NOVX protein has an amino acid sequence shown SEQ ID NOS:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 65, 67, 69, 71, 73, 75, 77, 79, 81, 83, 85, 87, 89, 91, 93, 95, 97, 99, 101, 103, 105, 107, 109, 111, 113, 115, 117, 119, 121, and 123. In other embodiments, the NOVX protein is substantially homologous to SEQ ID NOS:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 65, 67, 69, 71, 73, 75, 77, 79, 81, 83, 85, 87, 89, 91, 93, 95, 97, 99, 101, 103, 105, 107, 109, 111, 113, 115, 117, 119, 121, and 123, and retains the functional activity of the protein of SEQ ID NOS:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 65, 67, 69, 71, 73, 75, 77, 79, 81, 83, 85, 87, 89, 91, 93, 95, 97, 99, 101, 103, 105, 107, 109, 111, 113, 115, 117, 119, 121, and 123, yet differs in amino acid sequence due to natural allelic variation or mutagenesis, as described in detail, below. Accordingly, in another embodiment, the NOVX protein is a protein that comprises an amino acid sequence at least about 45% homologous to the amino acid sequence SEQ ID NOS:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 65, 67, 69, 71, 73, 75, 77, 79, 81, 83, 85, 87, 89, 91, 93, 95, 97, 99, 101, 103, 105, 107, 109, 111, 113, 115, 117, 119, 121, and 123, and retains the functional activity of the NOVX proteins of SEQ ID NOS:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 65, 67, 69, 71, 73, 75, 77, 79, 81, 83, 85, 87, 89, 91, 93, 95, 97, 99, 101, 103, 105, 107, 109, 111, 113, 115, 117, 119, 121, and 123.

Determining Homology Between Two or More Sequences

To determine the percent homology of two amino acid sequences or of two nucleic acids, the sequences are aligned for optimal comparison purposes (e.g., gaps can be introduced in the sequence of a first amino acid or nucleic acid sequence for optimal alignment with a second amino or nucleic acid sequence). The amino acid residues or nucleotides at corresponding amino acid positions or nucleotide positions are then compared. When a position in the first sequence is occupied by the same amino acid residue or nucleotide as the corresponding position in the second sequence, then the molecules are homologous at that position (i.e., as used herein amino acid or nucleic acid "homology" is equivalent to amino acid or nucleic acid "identity").

The nucleic acid sequence homology may be determined as the degree of identity between two sequences. The homology may be determined using computer programs known in the art, such as GAP software provided in the GCG program package. See, Needleman and Wunsch, 1970. *J Mol Biol* 48: 443–453. Using GCG GAP software with the following settings for nucleic acid sequence comparison: GAP creation penalty of 5.0 and GAP extension penalty of 0.3, the coding region of the analogous nucleic acid sequences referred to above exhibits a degree of identity preferably of at least 70%, 75%, 80%, 85%, 90%, 95%, 98%, or 99%, with the CDS (encoding) part of the DNA sequence shown in SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 64, 66, 68, 70, 72, 74, 76, 78, 80, 82, 84, 86, 88, 90, 92, 94, 96, 98, 100, 102, 104, 106, 108, 110, 112, 114, 116, 118, 120, and 122. The term "sequence identity" refers to the degree to which two polynucleotide or polypeptide sequences are identical on a residue-by-residue basis over a particular region of comparison. The term "percentage of sequence identity" is calculated by comparing two optimally aligned sequences over that region of comparison, determining the number of positions at which the identical nucleic acid base (e.g. A, T, C, G, U, or I, in the case of nucleic acids) occurs in both sequences to yield the number of matched positions, dividing the number of matched positions by the total number of positions in the region of comparison (i.e., the window size), and multiplying the result by 100 to yield the percentage of sequence identity.

The term "substantial identity" as used herein denotes a characteristic of a polynucleotide sequence, wherein the polynucleotide comprises a sequence that has at least 80 percent sequence identity, preferably at least 85 percent identity and often 90 to 95 percent sequence identity, more usually at least 99 percent sequence identity as compared to a reference sequence over a comparison region.

Chimeric and Fusion Proteins

The invention also provides NOVX chimeric or fusion proteins. As used herein, an NOVX "chimeric protein" or "fusion protein" comprises an NOVX polypeptide operatively-linked to a non-NOVX polypeptide. An "NOVX polypeptide" refers to a polypeptide having an amino acid sequence corresponding to an NOVX protein SEQ ID NOS: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 65, 67, 69, 71, 73, 75, 77, 79, 81, 83, 85, 87, 89, 91, 93, 95, 97, 99, 101, 103, 105, 107, 109, 111, 113, 115, 117, 119, 121, and 123, whereas a "non-NOVX polypeptide" refers to a polypeptide having an amino acid sequence corresponding to a protein that is not substantially homologous to the NOVX protein, e.g., a protein that is different from the NOVX protein and that is derived from the same or a different organism. Within an NOVX fusion protein the NOVX polypeptide can correspond to all or a portion of an NOVX protein. In one embodiment, an NOVX fusion protein comprises at least one biologically-active portion of an NOVX protein. In another embodiment, an NOVX fusion protein comprises at least two biologically-active portions of an NOVX protein. In yet another embodiment, an NOVX fusion protein comprises at least three biologically-active portions of an NOVX protein. Within the fusion protein, the term "operatively-linked" is intended to indicate that the NOVX polypeptide and the non-NOVX polypeptide are fused in-frame with one another. The non-NOVX polypeptide can be fused to the N-terminus or C-terminus of the NOVX polypeptide.

In one embodiment, the fusion protein is a GST-NOVX fusion protein in which the NOVX sequences are fused to the C-terminus of the GST (glutathione S-transferase) sequences. Such fusion proteins can facilitate the purification of recombinant NOVX polypeptides.

In another embodiment, the fusion protein is an NOVX protein containing a heterologous signal sequence at its N-terminus. In certain host cells (e.g., mammalian host cells), expression and/or secretion of NOVX can be increased through use of a heterologous signal sequence.

In yet another embodiment, the fusion protein is an NOVX-immunoglobulin fusion protein in which the NOVX sequences are fused to sequences derived from a member of the immunoglobulin protein family. The NOVX-immunoglobulin fusion proteins of the invention can be incorporated into pharmaceutical compositions and administered to a subject to inhibit an interaction between an NOVX ligand and an NOVX protein on the surface of a cell, to thereby suppress NOVX-mediated signal transduction in vivo. The NOVX-immunoglobulin fusion proteins can be used to affect the bioavailability of an NOVX cognate ligand. Inhibition of the NOVX ligand/NOVX interaction may be useful therapeutically for both the treatment of proliferative and differentiative disorders, as well as modulating (e.g. promoting or inhibiting) cell survival. Moreover, the NOVX-immunoglobulin fusion proteins of the invention can be used as immunogens to produce anti-NOVX antibodies in a subject, to purify NOVX ligands, and in screening assays to identify molecules that inhibit the interaction of NOVX with an NOVX ligand.

An NOVX chimeric or fusion protein of the invention can be produced by standard recombinant DNA techniques. For example, DNA fragments coding for the different polypeptide sequences are ligated together in-frame in accordance with conventional techniques, e.g., by employing blunt-ended or stagger-ended termini for ligation, restriction enzyme digestion to provide for appropriate termini, filling-in of cohesive ends as appropriate, alkaline phosphatase treatment to avoid undesirable joining, and enzymatic ligation. In another embodiment, the fusion gene can be synthesized by conventional techniques including automated DNA synthesizers. Alternatively, PCR amplification of gene fragments can be carried out using anchor primers that give rise to complementary overhangs between two consecutive gene fragments that can subsequently be annealed and reamplified to generate a chimeric gene sequence (see, e.g., Ausubel, et al. (eds.) CURRENT PROTOCOLS IN MOLECULAR BIOLOGY, John Wiley & Sons, 1992). Moreover, many expression vectors are commercially available that already encode a fusion moiety (e.g., a GST polypeptide). An NOVX-encoding nucleic acid can be cloned into such an expression vector such that the fusion moiety is linked in-frame to the NOVX protein.

NOVX Agonists and Antagonists

The invention also pertains to variants of the NOVX proteins that function as either NOVX agonists (i.e., mimetics) or as NOVX antagonists. Variants of the NOVX protein can be generated by mutagenesis (e.g., discrete point mutation or truncation of the NOVX protein). An agonist of the NOVX protein can retain substantially the same, or a subset of, the biological activities of the naturally occurring form of the NOVX protein. An antagonist of the NOVX protein can inhibit one or more of the activities of the naturally occurring form of the NOVX protein by, for example, competitively binding to a downstream or upstream member of a cellular signaling cascade which includes the NOVX protein. Thus, specific biological effects can be elicited by treatment with a variant of limited function. In one embodiment, treatment of a subject with a variant having a subset of the biological activities of the naturally occurring form of the protein has fewer side effects in a subject relative to treatment with the naturally occurring form of the NOVX proteins.

Variants of the NOVX proteins that function as either NOVX agonists (i.e., mimetics) or as NOVX antagonists can be identified by screening combinatorial libraries of mutants (e.g., truncation mutants) of the NOVX proteins for NOVX protein agonist or antagonist activity. In one embodiment, a variegated library of NOVX variants is generated by combinatorial mutagenesis at the nucleic acid level and is encoded by a variegated gene library. A variegated library of NOVX variants can be produced by, for example, enzymatically ligating a mixture of synthetic oligonucleotides into gene sequences such that a degenerate set of potential NOVX sequences is expressible as individual polypeptides, or alternatively, as a set of larger fusion proteins (e.g., for phage display) containing the set of NOVX sequences therein. There are a variety of methods which can be used to produce libraries of potential NOVX variants from a degenerate oligonucleotide sequence. Chemical synthesis of a degenerate gene sequence can be performed in an automatic DNA synthesizer, and the synthetic gene then ligated into an appropriate expression vector. Use of a degenerate set of genes allows for the provision, in one mixture, of all of the sequences encoding the desired set of potential NOVX sequences. Methods for synthesizing degenerate oligonucleotides are well-known within the art. See, e.g., Narang, 1983. *Tetrahedron* 39: 3; Itakura, et al., 1984. *Annu. Rev. Biochem.* 53: 323; Itakura, et al., 1984. *Science* 198: 1056; Ike, et al., 1983. *Nucl. Acids Res.* 11: 477.

Polypeptide Libraries

In addition, libraries of fragments of the NOVX protein coding sequences can be used to generate a variegated population of NOVX fragments for screening and subsequent selection of variants of an NOVX protein. In one embodiment, a library of coding sequence fragments can be generated by treating a double stranded PCR fragment of an NOVX coding sequence with a nuclease under conditions wherein nicking occurs only about once per molecule, denaturing the double stranded DNA, renaturing the DNA to form double-stranded DNA that can include sense/antisense pairs from different nicked products, removing single stranded portions from reformed duplexes by treatment with $S_1$ nuclease, and ligating the resulting fragment library into an expression vector. By this method, expression libraries can be derived which encodes N-terminal and internal fragments of various sizes of the NOVX proteins.

Various techniques are known in the art for screening gene products of combinatorial libraries made by point mutations or truncation, and for screening cDNA libraries for gene products having a selected property. Such techniques are adaptable for rapid screening of the gene libraries generated by the combinatorial mutagenesis of NOVX proteins. The most widely used techniques, which are amenable to high throughput analysis, for screening large gene libraries typically include cloning the gene library into replicable expression vectors, transforming appropriate cells with the resulting library of vectors, and expressing the combinatorial genes under conditions in which detection of a desired activity facilitates isolation of the vector encoding the gene whose product was detected. Recursive ensemble mutagenesis (REM), a new technique that enhances the frequency of functional mutants in the libraries, can be used in combination with the screening assays to identify NOVX variants. See, e.g., Arkin and Yourvan, 1992. *Proc. Natl. Acad. Sci. USA* 89: 7811–7815; Delgrave, et al., 1993. *Protein Engineering* 6:327–331.

Anti-NOVX Antibodies

The term "antibody" as used herein refers to immunoglobulin molecules and immunologically active portions of immunoglobulin (Ig) molecules, i.e., molecules that contain an antigen binding site that specifically binds (immunoreacts with) an antigen. Such antibodies include, but are not limited to, polyclonal, monoclonal, chimeric, single chain, $F_{ab}$, $F_{ab'}$ and $F_{(ab')2}$ fragments, and an $F_{ab}$ expression library. In general, antibody molecules obtained from humans relates to any of the classes IgG, IgM, IgA, IgE and IgD, which differ from one another by the nature of the heavy chain present in the molecule. Certain classes have subclasses as well, such as $IgG_1$, $IgG_2$, and others. Furthermore, in humans, the light chain may be a kappa chain or a lambda chain. Reference herein to antibodies includes a reference to all such classes, subclasses and types of human antibody species.

An isolated protein of the invention intended to serve as an antigen, or a portion or fragment thereof, can be used as an immunogen to generate antibodies that immunospecifically bind the antigen, using standard techniques for polyclonal and monoclonal antibody preparation. The full-length protein can be used or, alternatively, the invention provides antigenic peptide fragments of the antigen for use as immunogens. An antigenic peptide fragment comprises at least 6 amino acid residues of the amino acid sequence of the full length protein, such as an amino acid sequence shown in SEQ ID NOS:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 65, 67, 69, 71, 73, 75, 77, 79, 81, 83, 85, 87, 89, 91, 93, 95, 97, 99, 101, 103, 105, 107, 109, 111, 113, 115, 117, 119, 121, and 123, and encompasses an epitope thereof such that an antibody raised against the peptide forms a specific immune complex with the full length protein or with any fragment that contains the epitope. Preferably, the antigenic peptide comprises at least 10 amino acid residues, or at least 15 amino acid residues, or at least 20 amino acid residues, or at least 30 amino acid residues. Preferred epitopes encompassed by the antigenic peptide are regions of the protein that are located on its surface; commonly these are hydrophilic regions.

In certain embodiments of the invention, at least one epitope encompassed by the antigenic peptide is a region of SECX that is located on the surface of the protein, e.g., a hydrophilic region. A hydrophobicity analysis of the human SECX protein sequence will indicate which regions of a SECX polypeptide are particularly hydrophilic and, therefore, are likely to encode surface residues useful for targeting antibody production. As a means for targeting antibody production, hydropathy plots showing regions of hydrophilicity and hydrophobicity may be generated by any method well known in the art, including, for example, the Kyte Doolittle or the Hopp Woods methods, either with or without Fourier transformation. See, e.g., Hopp and Woods, 1981, *Proc. Nat. Acad. Sci. USA* 78: 3824–3828; Kyte and Doolittle 1982, *J. Mol. Biol.* 157: 105–142, each incorporated herein by reference in their entirety. Antibodies that are specific for one or more domains within an antigenic protein, or derivatives, fragments, analogs or homologs thereof, are also provided herein.

A protein of the invention, or a derivative, fragment, analog, homolog or ortholog thereof, may be utilized as an immunogen in the generation of antibodies that immunospecifically bind these protein components.

Various procedures known within the art may be used for the production of polyclonal or monoclonal antibodies directed against a protein of the invention, or against derivatives, fragments, analogs homologs or orthologs thereof (see, for example, Antibodies: A Laboratory Manual, Harlow E, and Lane D, 1988, Cold Spring Harbor Laboratory Press, Cold Spring Harbor, N.Y., incorporated herein by reference). Some of these antibodies are discussed below.

1. Polyclonal Antibodies

For the production of polyclonal antibodies, various suitable host animals (e.g., rabbit, goat, mouse or other mammal) may be immunized by one or more injections with the native protein, a synthetic variant thereof, or a derivative of the foregoing. An appropriate immunogenic preparation can contain, for example, the naturally occurring immunogenic protein, a chemically synthesized polypeptide representing the immunogenic protein, or a recombinantly expressed immunogenic protein. Furthermore, the protein may be conjugated to a second protein known to be immunogenic in the mammal being immunized. Examples of such immunogenic proteins include but are not limited to keyhole limpet hemocyanin, serum albumin, bovine thyroglobulin, and soybean trypsin inhibitor. The preparation can further include an adjuvant. Various adjuvants used to increase the immunological response include, but are not limited to, Freund's (complete and incomplete), mineral gels (e.g., aluminum hydroxide), surface active substances (e.g., lysolecithin, pluronic polyols, polyanions, peptides, oil emulsions, dinitrophenol, etc.), adjuvants usable in humans such as Bacille Calmette-Guerin and *Corynebacterium parvum*, or similar immunostimulatory agents. Additional examples of adjuvants which can be employed include MPL-TDM adjuvant (monophosphoryl Lipid A, synthetic trehalose dicorynomycolate).

The polyclonal antibody molecules directed against the immunogenic protein can be isolated from the mammal (e.g., from the blood) and further purified by well known techniques, such as affinity chromatography using protein A or protein G, which provide primarily the IgG fraction of immune serum. Subsequently, or alternatively, the specific antigen which is the target of the immunoglobulin sought, or an epitope thereof, may be immobilized on a column to purify the immune specific antibody by immunoaffinity chromatography. Purification of immunoglobulins is discussed, for example, by D. Wilkinson (The Scientist, published by The Scientist, Inc., Philadelphia Pa., Vol. 14, No. 8 (Apr. 17, 2000), pp. 25–28).

2. Monoclonal Antibodies

The term "monoclonal antibody" (MAb) or "monoclonal antibody composition", as used herein, refers to a population of antibody molecules that contain only one molecular species of antibody molecule consisting of a unique light chain gene product and a unique heavy chain gene product. In particular, the complementarity determining regions (CDRs) of the monoclonal antibody are identical in all the molecules of the population. MAbs thus contain an antigen binding site capable of immunoreacting with a particular epitope of the antigen characterized by a unique binding affinity for it.

Monoclonal antibodies can be prepared using hybridoma methods, such as those described by Kohler and Milstein, *Nature*, 256:495 (1975). In a hybridoma method, a mouse, hamster, or other appropriate host animal, is typically immunized with an immunizing agent to elicit lymphocytes that produce or are capable of producing antibodies that will specifically bind to the immunizing agent. Alternatively, the lymphocytes can be immunized in vitro.

The immunizing agent will typically include the protein antigen, a fragment thereof or a fusion protein thereof. Generally, either peripheral blood lymphocytes are used if cells of human origin are desired, or spleen cells or lymph node cells are used if non-human mammalian sources are desired. The lymphocytes are then fused with an immortalized cell line using a suitable fusing agent, such as polyethylene glycol, to form a hybridoma cell [Goding, *Monoclonal Antibodies: Principles and Practice*, Academic Press, (1986) pp. 59–103]. Immortalized cell lines are usually transformed mammalian cells, particularly myeloma cells of rodent, bovine and human origin. Usually, rat or mouse myeloma cell lines are employed. The hybridoma cells can be cultured in a suitable culture medium that preferably contains one or more substances that inhibit the growth or survival of the unfused, immortalized cells. For example, if the parental cells lack the enzyme hypoxanthine guanine phosphoribosyl transferase (HGPRT or HPRT), the culture medium for the hybridomas typically will include hypoxanthine, aminopterin, and thymidine ("HAT medium"), which substances prevent the growth of HGPRT-deficient cells.

Preferred immortalized cell lines are those that fuse efficiently, support stable high level expression of antibody by the selected antibody-producing cells, and are sensitive to a medium such as HAT medium. More preferred immortalized cell lines are murine myeloma lines, which can be obtained, for instance, from the Salk Institute Cell Distribution Center, San Diego, Calif. and the American Type Culture Collection, Manassas, Va. Human myeloma and mouse-human heteromyeloma cell lines also have been described for the production of human monoclonal antibodies [Kozbor, *J. Immunol.*, 133:3001 (1984); Brodeur et al., *Monoclonal Antibody Production Techniques and Applications*, Marcel Dekker, Inc., New York, (1987) pp. 51–63].

The culture medium in which the hybridoma cells are cultured can then be assayed for the presence of monoclonal antibodies directed against the antigen. Preferably, the binding specificity of monoclonal antibodies produced by the hybridoma cells is determined by immunoprecipitation or by an in vitro binding assay, such as radioimmunoassay (RIA) or enzyme-linked immunoabsorbent assay (ELISA). Such techniques and assays are known in the art. The binding affinity of the monoclonal antibody can, for example, be determined by the Scatchard analysis of Munson and Pollard, *Anal. Biochem.* 107:220 (1980). It is an objective, especially important in therapeutic applications of monoclonal antibodies, to identify antibodies having a high degree of specificity and a high binding affinity for the target antigen.

After the desired hybridoma cells are identified, the clones can be subcloned by limiting dilution procedures and grown by standard methods (Goding, 1986). Suitable culture media for this purpose include, for example, Dulbecco's Modified Eagle's Medium and RPMI-1640 medium. Alternatively, the hybridoma cells can be grown in vivo as ascites in a mammal.

The monoclonal antibodies secreted by the subclones can be isolated or purified from the culture medium or ascites fluid by conventional immunoglobulin purification procedures such as, for example, protein A-Sepharose, hydroxylapatite chromatography, gel electrophoresis, dialysis, or affinity chromatography.

The monoclonal antibodies can also be made by recombinant DNA methods, such as those described in U.S. Pat. No. 4,816,567. DNA encoding the monoclonal antibodies of the invention can be readily isolated and sequenced using conventional procedures (e.g., by using oligonucleotide probes that are capable of binding specifically to genes encoding the heavy and light chains of murine antibodies). The hybridoma cells of the invention serve as a preferred source of such DNA. Once isolated, the DNA can be placed into expression vectors, which are then transfected into host cells such as simian COS cells, Chinese hamster ovary (CHO) cells, or myeloma cells that do not otherwise produce immunoglobulin protein, to obtain the synthesis of monoclonal antibodies in the recombinant host cells. The DNA also can be modified, for example, by substituting the coding sequence for human heavy and light chain constant domains in place of the homologous murine sequences (U.S. Pat. No. 4,816,567; Morrison, *Nature* 368 812–13 (1994)) or by covalently joining to the immunoglobulin coding sequence all or part of the coding sequence for a non-immunoglobulin polypeptide. Such a non-immunoglobulin polypeptide can be substituted for the constant domains of an antibody of the invention, or can be substituted for the variable domains of one antigen-combining site of an antibody of the invention to create a chimeric bivalent antibody.

3. Humanized Antibodies

The antibodies directed against the protein antigens of the invention can further comprise humanized antibodies or human antibodies. These antibodies are suitable for administration to humans without engendering an immune response by the human against the administered immunoglobulin. Humanized forms of antibodies are chimeric immunoglobulins, immunoglobulin chains or fragments thereof (such as Fv, Fab, Fab', F(ab')$_2$ or other antigen-binding subsequences of antibodies) that are principally comprised of the sequence of a human immunoglobulin, and contain minimal sequence derived from a non-human immunoglobulin. Humanization can be performed following the method of Winter and co-workers (Jones et al., *Nature*, 321:522–525(1986); Riechmann et al., *Nature*, 332:323–327 (1988); Verhoeyen et al., *Science*, 239:1534–1536(1988)), by substituting rodent CDRs or CDR sequences for the corresponding sequences of a human antibody. (See also U.S. Pat. No. 5,225,539.) In some instances, Fv framework residues of the human immunoglobulin are replaced by corresponding non-human residues. Humanized antibodies can also comprise residues which are found neither in the recipient antibody nor in the imported CDR or framework sequences. In general, the humanized antibody will comprise substantially all of at least one, and typically two, variable domains, in which all or substantially all of the CDR regions correspond to those of a non-human immunoglobulin and all or substantially all of the framework regions are those of a human immunoglobulin consensus sequence. The humanized antibody optimally also will comprise at least a portion of an immunoglobulin constant region (Fc), typically that of a human immunoglobulin (Jones et al., 1986; Riechmann et al., 1988; and Presta, *Curr. Op. Struct. Biol.*, 2:593–596(1992)).

4. Human Antibodies

Fully human antibodies essentially relate to antibody molecules in which the entire sequence of both the light chain and the heavy chain, including the CDRs, arise from human genes. Such antibodies are termed "human antibodies", or "fully human antibodies" herein. Human monoclonal antibodies can be prepared by the trioma technique; the human B-cell hybridoma technique (see Kozbor, et al., 1983 Immunol Today 4: 72) and the EBV hybridoma technique to produce human monoclonal antibodies (see Cole, et al., 1985 In: MONOCLONAL ANTIBODIES AND CANCER THERAPY, Alan R. Liss, Inc., pp. 77–96). Human monoclonal antibodies may be utilized in the practice of the present invention and may be produced by using human hybridomas (see Cote, et al., 1983. Proc Natl Acad Sci USA 80: 2026–2030) or by transforming human B-cells with Epstein Barr Virus in vitro (see Cole, et al., 1985 In: MONOCLONAL ANTIBODIES AND CANCER THERAPY, Alan R. Liss, Inc., pp. 77–96).

In addition, human antibodies can also be produced using additional techniques, including phage display libraries (Hoogenboom and Winter, *J. Mol. Biol.*, 227:381 (1991); Marks et al., *J. Mol. Biol.*, 222:581 (1991)). Similarly, human antibodies can be made by introducing human immunoglobulin loci into transgenic animals, e.g., mice in which the endogenous immunoglobulin genes have been partially or completely inactivated. Upon challenge, human antibody production is observed, which closely resembles that seen in humans in all respects, including gene rearrangement, assembly, and antibody repertoire. This approach is described, for example, in U.S. Pat. Nos. 5,545,807; 5,545,806; 5,569,825; 5,625,126; 5,633,425; 5,661,016, and in Marks et al. (Bio/Technology 10, 779–783 (1992)); Lonberg et al. (*Nature* 368 856–859 (1994)); Morrison (*Nature* 368, 812–13 (1994)); Fishwild et al, (*Nature Biotechnology* 14, 845–51 (1996)); Neuberger (*Nature Biotechnology* 14, 826 (1996)); and Lonberg and Huszar (*Intern. Rev. Immunol.* 13 65–93 (1995)).

Human antibodies may additionally be produced using transgenic nonhuman animals which are modified so as to produce fully human antibodies rather than the animal's endogenous antibodies in response to challenge by an antigen. (See PCT publication WO94/02602). The endogenous genes encoding the heavy and light immunoglobulin chains in the nonhuman host have been incapacitated, and active loci encoding human heavy and light chain immunoglobulins are inserted into the host's genome. The human genes are incorporated, for example, using yeast artificial chromosomes containing the requisite human DNA segments. An animal which provides all the desired modifications is then obtained as progeny by crossbreeding intermediate transgenic animals containing fewer than the full complement of the modifications. The preferred embodiment of such a nonhuman animal is a mouse, and is termed the Xenomouse™ as disclosed in PCT publications WO 96/33735 and WO 96/34096. This animal produces B cells which secrete fully human immunoglobulins. The antibodies can be obtained directly from the animal after immunization with an immunogen of interest, as, for example, a preparation of a polyclonal antibody, or alternatively from immortalized B cells derived from the animal, such as hybridomas producing monoclonal antibodies. Additionally, the genes encoding the immunoglobulins with human variable regions can be recovered and expressed to obtain the antibodies directly, or can be further modified to obtain analogs of antibodies such as, for example, single chain Fv molecules.

An example of a method of producing a nonhuman host, exemplified as a mouse, lacking expression of an endogenous immunoglobulin heavy chain is disclosed in U.S. Pat. No. 5,939,598. It can be obtained by a method including deleting the J segment genes from at least one endogenous heavy chain locus in an embryonic stem cell to prevent rearrangement of the locus and to prevent formation of a transcript of a rearranged immunoglobulin heavy chain locus, the deletion being effected by a targeting vector containing a gene encoding a selectable marker; and producing from the embryonic stem cell a transgenic mouse whose somatic and germ cells contain the gene encoding the selectable marker.

A method for producing an antibody of interest, such as a human antibody, is disclosed in U.S. Pat. No. 5,916,771. It includes introducing an expression vector that contains a nucleotide sequence encoding a heavy chain into one mammalian host cell in culture, introducing an expression vector containing a nucleotide sequence encoding a light chain into another mammalian host cell, and fusing the two cells to form a hybrid cell. The hybrid cell expresses an antibody containing the heavy chain and the light chain.

In a further improvement on this procedure, a method for identifying a clinically relevant epitope on an immunogen, and a correlative method for selecting an antibody that binds immunospecifically to the relevant epitope with high affinity, are disclosed in PCT publication WO 99/53049.

5. $F_{ab}$ Fragments and Single Chain Antibodies

According to the invention, techniques can be adapted for the production of single-chain antibodies specific to an antigenic protein of the invention (see e.g., U.S. Pat. No. 4,946,778). In addition, methods can be adapted for the construction of $F_{ab}$ expression libraries (see e.g., Huse, et al., 1989 Science 246: 1275–1281) to allow rapid and effective identification of monoclonal $F_{ab}$ fragments with the desired specificity for a protein or derivatives, fragments, analogs or homologs thereof. Antibody fragments that contain the idiotypes to a protein antigen may be produced by techniques known in the art including, but not limited to: (i) an $F_{(ab')2}$ fragment produced by pepsin digestion of an antibody molecule; (ii) an $F_{ab}$ fragment generated by reducing the disulfide bridges of an $F_{(ab')2}$ fragment; (iii) an $F_{ab}$ fragment generated by the treatment of the antibody molecule with papain and a reducing agent and (iv) $F_v$ fragments.

6. Bispecific Antibodies

Bispecific antibodies are monoclonal, preferably human or humanized, antibodies that have binding specificities for at least two different antigens. In the present case, one of the binding specificities is for an antigenic protein of the invention. The second binding target is any other antigen, and advantageously is a cell-surface protein or receptor or receptor subunit.

Methods for making bispecific antibodies are known in the art. Traditionally, the recombinant production of bispecific antibodies is based on the co-expression of two immunoglobulin heavy-chain/light-chain pairs, where the two heavy chains have different specificities (Milstein and Cuello, Nature, 305:537–539(1983)). Because of the random assortment of immunoglobulin heavy and light chains, these hybridomas (quadromas) produce a potential mixture of ten different antibody molecules, of which only one has the correct bispecific structure. The purification of the correct molecule is usually accomplished by affinity chromatography steps. Similar procedures are disclosed in WO 93/08829, published 13 May 1993, and in Traunecker et al., EMBO J. 10:3655–3659(1991).

Antibody variable domains with the desired binding specificities (antibody-antigen combining sites) can be fused to immunoglobulin constant domain sequences. The fusion preferably is with an immunoglobulin heavy-chain constant domain, comprising at least part of the hinge, CH2, and CH3 regions. It is preferred to have the first heavy-chain constant region (CH1) containing the site necessary for light-chain binding present in at least one of the fusions. DNAs encoding the immunoglobulin heavy-chain fusions and, if desired, the immunoglobulin light chain, are inserted into separate expression vectors, and are co-transfected into a suitable host organism. For further details of generating bispecific antibodies see, for example, Suresh et al., Methods in Enzymology, 121:210 (1986).

According to another approach described in WO 96/27011, the interface between a pair of antibody molecules can be engineered to maximize the percentage of heterodimers which are recovered from recombinant cell culture. The preferred interface comprises at least a part of the CH3 region of an antibody constant domain. In this method, one or more small amino acid side chains from the interface of the first antibody molecule are replaced with larger side chains (e.g. tyrosine or tryptophan). Compensatory "cavities" of identical or similar size to the large side chain(s) are created on the interface of the second antibody molecule by replacing large amino acid side chains with smaller ones (e.g. alanine or threonine). This provides a mechanism for increasing the yield of the heterodimer over other unwanted end-products such as homodimers.

Bispecific antibodies can be prepared as full length antibodies or antibody fragments (e.g. F(ab')$_2$ bispecific antibodies). Techniques for generating bispecific antibodies from antibody fragments have been described in the literature. For example, bispecific antibodies can be prepared using chemical linkage. Brennan et al., Science 229:81 (1985) describe a procedure wherein intact antibodies are proteolytically cleaved to generate F(ab')$_2$ fragments. These fragments are reduced in the presence of the dithiol complexing agent sodium arsenite to stabilize vicinal dithiols and prevent intermolecular disulfide formation. The Fab' fragments generated are then converted to thionitrobenzoate (TNB) derivatives. One of the Fab'-TNB derivatives is then reconverted to the Fab'-thiol by reduction with mercaptoethylamine and is mixed with an equimolar amount of the other Fab'-TNB derivative to form the bispecific antibody. The bispecific antibodies produced can be used as agents for the selective immobilization of enzymes.

Additionally, Fab' fragments can be directly recovered from E. coli and chemically coupled to form bispecific antibodies. Shalaby et al., J. Exp. Med. 175:217–225(1992) describe the production of a fully humanized bispecific antibody F(ab')$_2$ molecule. Each Fab' fragment was separately secreted from E. coli and subjected to directed chemical coupling in vitro to form the bispecific antibody. The bispecific antibody thus formed was able to bind to cells overexpressing the ErbB2 receptor and normal human T cells, as well as trigger the lytic activity of human cytotoxic lymphocytes against human breast tumor targets.

Various techniques for making and isolating bispecific antibody fragments directly from recombinant cell culture have also been described. For example, bispecific antibodies have been produced using leucine zippers. Kostelny et al., J. Immunol. 148(5):1547–1553(1992). The leucine zipper peptides from the Fos and Jun proteins were linked to the Fab' portions of two different antibodies by gene fusion. The antibody homodimers were reduced at the hinge region to form monomers and then re-oxidized to form the antibody heterodimers. This method can also be utilized for the production of antibody homodimers. The "diabody" technology described by Hollinger et al., *Proc. Natl. Acad. Sci. USA* 90:6444–6448(1993) has provided an alternative mechanism for making bispecific antibody fragments. The fragments comprise a heavy-chain variable domain ($V_H$) connected to a light-chain variable domain ($V_L$) by a linker which is too short to allow pairing between the two domains on the same chain. Accordingly, the $V_H$ and $V_L$ domains of one fragment are forced to pair with the complementary $V_L$ and $V_H$ domains of another fragment, thereby forming two antigen-binding sites. Another strategy for making bispecific antibody fragments by the use of single-chain Fv (sFv) dimers has also been reported. See, Gruber et al., *J. Immunol.* 152:5368 (1994).

Antibodies with more than two valencies are contemplated. For example, trispecific antibodies can be prepared. Tutt et al., *J. Immunol.* 147:60 (1991).

Exemplary bispecific antibodies can bind to two different epitopes, at least one of which originates in the protein antigen of the invention. Alternatively, an anti-antigenic arm of an immunoglobulin molecule can be combined with an arm which binds to a triggering molecule on a leukocyte such as a T-cell receptor molecule (e.g. CD2, CD3, CD28, or B7), or Fc receptors for IgG (FcγR), such as FcγRI (CD64), FcγII (CD32) and FcγRIII (CD16) so as to focus cellular defense mechanisms to the cell expressing the particular antigen. Bispecific antibodies can also be used to direct cytotoxic agents to cells which express a particular antigen. These antibodies possess an antigen-binding arm and an arm which binds a cytotoxic agent or a radionuclide chelator, such as EOTUBE, DPTA, DOTA, or TETA. Another bispecific antibody of interest binds the protein antigen described herein and further binds tissue factor (TF).

7. Heteroconjugate Antibodies

Heteroconjugate antibodies are also within the scope of the present invention. Heteroconjugate antibodies are composed of two covalently joined antibodies. Such antibodies have, for example, been proposed to target immune system cells to unwanted cells (U.S. Pat. No. 4,676,980), and for treatment of HIV infection (WO 91/00360; WO 92/200373; EP 03089). It is contemplated that the antibodies can be prepared in vitro using known methods in synthetic protein chemistry, including those involving crosslinking agents. For example, immunotoxins can be constructed using a disulfide exchange reaction or by forming a thioether bond. Examples of suitable reagents for this purpose include iminothiolate and methyl-4mercaptobutyrimidate and those disclosed, for example, in U.S. Pat. No. 4,676,980.

8. Effector Function Engineering

It can be desirable to modify the antibody of the invention with respect to effector function, so as to enhance, e.g., the effectiveness of the antibody in treating cancer. For example, cysteine residue(s) can be introduced into the Fc region, thereby allowing interchain disulfide bond formation in this region. The homodimeric antibody thus generated can have improved internalization capability and/or increased complement-mediated cell killing and antibody-dependent cellular cytotoxicity (ADCC). See Caron et al., *J. Exp Med.*, 176: 1191–1195 (1992) and Shopes, *J. Immunol.*, 148: 2918–2922(1992). Homodimeric antibodies with enhanced anti-tumor activity can also be prepared using heterobifunctional cross-linkers as described in Wolff et al. *Cancer Research,* 53: 2560–2565(1993). Alternatively, an antibody can be engineered that has dual Fc regions and can thereby have enhanced complement lysis and ADCC capabilities. See Stevenson et al., *Anti-Cancer Drug Design,* 3: 219–230 (1989).

9. Immunoconjugates

The invention also pertains to immunoconjugates comprising an antibody conjugated to a cytotoxic agent such as a chemotherapeutic agent, toxin (e.g., an enzymatically active toxin of bacterial, fungal, plant, or animal origin, or fragments thereof), or a radioactive isotope (i.e., a radioconjugate).

Chemotherapeutic agents useful in the generation of such immunoconjugates have been described above. Enzymatically active toxins and fragments thereof that can be used include diphtheria A chain, nonbinding active fragments of diphtheria toxin, exotoxin A chain (from *Pseudomonas aeruginosa*), ricin A chain, abrin A chain, modeccin A chain, alpha-sarcin, *Aleurites fordii* proteins, dianthin proteins, *Phytolaca americana* proteins (PAPI, PAPII, and PAP-S), momordica charantia inhibitor, curcin, crotin, sapaonaria officinalis inhibitor, gelonin, mitogellin, restrictocin, phenomycin, enomycin, and the tricothecenes. A variety of radionuclides are available for the production of radioconjugated antibodies. Examples include $^{212}$Bi, $^{131}$I, $^{131}$In, $^{90}$Y, and $^{186}$Re.

Conjugates of the antibody and cytotoxic agent are made using a variety of bifunctional protein-coupling agents such as N-succinimidyl-3-(2-pyridyldithiol) propionate (SPDP), iminothiolane (IT), bifunctional derivatives of imidoesters (such as dimethyl adipimidate HCL), active esters (such as disuccinimidyl suberate), aldehydes (such as glutaraldehyde), bis-azido compounds (such as bis (p-azidobenzoyl) hexanediamine), bis-diazonium derivatives (such as bis-(p-diazoniumbenzoyl)-ethylenediamine), diisocyanates (such as tolyene 2, 6-diisocyanate), and bis-active fluorine compounds (such as 1, 5-difluoro-2, 4-dinitrobenzene). For example, a ricin immunotoxin can be prepared as described in Vitetta et al., *Science,* 238: 1098 (1987). Carbon-14-labeled 1-isothiocyanatobenzyl-3-methyldiethylene triaminepentaacetic acid (MX-DTPA) is an exemplary chelating agent for conjugation of radionucleotide to the antibody. See WO94/11026.

In another embodiment, the antibody can be conjugated to a "receptor" (such streptavidin) for utilization in tumor pretargeting wherein the antibody-receptor conjugate is administered to the patient, followed by removal of unbound conjugate from the circulation using a clearing agent and then administration of a "ligand" (e.g., avidin) that is in turn conjugated to a cytotoxic agent.

10. Immunoliposomes

The antibodies disclosed herein can also be formulated as immunoliposomes. Liposomes containing the antibody are prepared by methods known in the art, such as described in Epstein et al., *Proc. Natl. Acad. Sci. USA* 82: 3688 (1985); Hwang et al., *Proc. Natl. Acad. Sci. USA,* 77: 4030 (1980); and U.S. Pat. Nos. 4,485,045 and 4,544,545. Liposomes with enhanced circulation time are disclosed in U.S. Pat. No. 5,013,556.

Particularly useful liposomes can be generated by the reverse-phase evaporation method with a lipid composition comprising phosphatidylcholine, cholesterol, and PEG-derivatized phosphatidylethanolamine (PEG-PE). Liposomes are extruded through filters of defined pore size to yield liposomes with the desired diameter. Fab' fragments of the antibody of the present invention can be conjugated to the liposomes as described in Martin et al., J. Biol. Chem. 257:

286–288 (1982) via a disulfide-interchange reaction. A chemotherapeutic agent (such as Doxorubicin) is optionally contained within the liposome. See Gabizon et al., J. National Cancer Inst., 81(19): 1484 (1989).

11. Diagnostic Applications of Antibodies Directed Against the Proteins of the Invention Antibodies directed against a protein of the invention may be used in methods known within the art relating to the localization and/or quantitation of the protein (e.g., for use in measuring levels of the protein within appropriate physiological samples, for use in diagnostic methods, for use in imaging the protein, and the like). In a given embodiment, antibodies against the proteins, or derivatives, fragments, analogs or homologs thereof, that contain the antigen binding domain, are utilized as pharmacologically-active compounds (see below).

An antibody specific for a protein of the invention can be used to isolate the protein by standard techniques, such as immunoaffinity chromatography or immunoprecipitation. Such an antibody can facilitate the purification of the natural protein antigen from cells and of recombinantly produced antigen expressed in host cells. Moreover, such an antibody can be used to detect the antigenic protein (e.g., in a cellular lysate or cell supernatant) in order to evaluate the abundance and pattern of expression of the antigenic protein. Antibodies directed against the protein can be used diagnostically to monitor protein levels in tissue as part of a clinical testing procedure, e.g., to, for example, determine the efficacy of a given treatment regimen. Detection can be facilitated by coupling (i.e., physically linking) the antibody to a detectable substance. Examples of detectable substances include various enzymes, prosthetic groups, fluorescent materials, luminescent materials, bioluminescent materials, and radioactive materials. Examples of suitable enzymes include horseradish peroxidase, alkaline phosphatase, O-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin, and examples of suitable radioactive material include $^{125}$I, $^{131}$I, $^{35}$S or $^3$H.

12. Antibody Therapeutics

Antibodies of the invention, including polyclonal, monoclonal, humanized and fully human antibodies, may used as therapeutic agents. Such agents will generally be employed to treat or prevent a disease or pathology in a subject. An antibody preparation, preferably one having high specificity and high affinity for its target antigen, is administered to the subject and will generally have an effect due to its binding with the target. Such an effect may be one of two kinds, depending on the specific nature of the interaction between the given antibody molecule and the target antigen in question. In the first instance, administration of the antibody may abrogate or inhibit the binding of the target with an endogenous ligand to which it naturally binds. In this case, the antibody binds to the target and masks a binding site of the naturally occurring ligand, wherein the ligand serves as an effector molecule. Thus the receptor mediates a signal transduction pathway for which ligand is responsible.

Alternatively, the effect may be one in which the antibody elicits a physiological result by virtue of binding to an effector binding site on the target molecule. In this case the target, a receptor having an endogenous ligand which may be absent or defective in the disease or pathology, binds the antibody as a surrogate effector ligand, initiating a receptor-based signal transduction event by the receptor.

A therapeutically effective amount of an antibody of the invention relates generally to the amount needed to achieve a therapeutic objective. As noted above, this may be a binding interaction between the antibody and its target antigen that, in certain cases, interferes with the functioning of the target, and in other cases, promotes a physiological response. The amount required to be administered will furthermore depend on the binding affinity of the antibody for its specific antigen, and will also depend on the rate at which an administered antibody is depleted from the free volume other subject to which it is administered. Common ranges for therapeutically effective dosing of an antibody or antibody fragment of the invention may be, by way of nonlimiting example, from about 0.1 mg/kg body weight to about 50 mg/kg body weight. Common dosing frequencies may range, for example, from twice daily to once a week.

13. Pharmaceutical Compositions of Antibodies

Antibodies specifically binding a protein of the invention, as well as other molecules identified by the screening assays disclosed herein, can be administered for the treatment of various disorders in the form of pharmaceutical compositions. Principles and considerations involved in preparing such compositions, as well as guidance in the choice of components are provided, for example, in Remington: The Science And Practice Of Pharmacy 19th ed. (Alfonso R. Gennaro, et al., editors) Mack Pub. Co., Easton, Pa.: 1995; Drug Absorption Enhancement: Concepts, Possibilities, Limitations, And Trends, Harwood Academic Publishers, Langhorne, Pa., 1994; and Peptide And Protein Drug Delivery (Advances In Parenteral Sciences, Vol. 4), 1991, M. Dekker, New York.

If the antigenic protein is intracellular and whole antibodies are used as inhibitors, internalizing antibodies are preferred. However, liposomes can also be used to deliver the antibody, or an antibody fragment, into cells. Where antibody fragments are used, the smallest inhibitory fragment that specifically binds to the binding domain of the target protein is preferred. For example, based upon the variable-region sequences of an antibody, peptide molecules can be designed that retain the ability to bind the target protein sequence. Such peptides can be synthesized chemically and/or produced by recombinant DNA technology. See, e.g., Marasco et al., Proc. Natl. Acad. Sci. USA, 90: 7889–7893 (1993). The formulation herein can also contain more than one active compound as necessary for the particular indication being treated, preferably those with complementary activities that do not adversely affect each other. Alternatively, or in addition, the composition can comprise an agent that enhances its function, such as, for example, a cytotoxic agent, cytokine, chemotherapeutic agent, or growth-inhibitory agent. Such molecules are suitably present in combination in amounts that are effective for the purpose intended.

The active ingredients can also be entrapped in microcapsules prepared, for example, by coacervation techniques or by interfacial polymerization, for example, hydroxymethylcellulose or gelatin-microcapsules and poly-(methylmethacrylate) microcapsules, respectively, in colloidal drug delivery systems (for example, liposomes, albumin microspheres, microemulsions, nanoparticles, and nanocapsules) or in macroemulsions.

The formulations to be used for in vivo administration must be sterile. This is readily accomplished by filtration through sterile filtration membranes.

Sustained-release preparations can be prepared. Suitable examples of sustained-release preparations include semipermeable matrices of solid hydrophobic polymers containing the antibody, which matrices are in the form of shaped articles, e.g., films, or microcapsules. Examples of sustained-release matrices include polyesters, hydrogels (for example, poly(2-hydroxyethyl-methacrylate), or poly(vinylalcohol)), polylactides (U.S. Pat. No. 3,773,919), copolymers of L-glutamic acid and γ ethyl-L-glutamate, non-degradable ethylene-vinyl acetate, degradable lactic acid-glycolic acid copolymers such as the LUPRON DEPOT™ (injectable microspheres composed of lactic acid-glycolic acid copolymer and leuprolide acetate), and poly-D-(-)-3-hydroxybutyric acid. While polymers such as ethylene-vinyl acetate and lactic acid-glycolic acid enable release of molecules for over 100 days, certain hydrogels release proteins for shorter time periods.

ELISA Assay

An agent for detecting an analyte protein is an antibody capable of binding to an analyte protein, preferably an antibody with a detectable label. Antibodies can be polyclonal, or more preferably, monoclonal. An intact antibody, or a fragment thereof (e.g., $F_{ab}$ or $F_{(ab)2}$) can be used. The term "labeled", with regard to the probe or antibody, is intended to encompass direct labeling of the probe or antibody by coupling (i.e., physically linking) a detectable substance to the probe or antibody, as well as indirect labeling of the probe or antibody by reactivity with another reagent that is directly labeled. Examples of indirect labeling include detection of a primary antibody using a fluorescently-labeled secondary antibody and end-labeling of a DNA probe with biotin such that it can be detected with fluorescently-labeled streptavidin. The term "biological sample" is intended to include tissues, cells and biological fluids isolated from a subject, as well as tissues, cells and fluids present within a subject. Included within the usage of the term "biological sample", therefore, is blood and a fraction or component of blood including blood serum, blood plasma, or lymph. That is, the detection method of the invention can be used to detect an analyte mRNA, protein, or genomic DNA in a biological sample in vitro as well as in vivo. For example, in vitro techniques for detection of an analyte mRNA include Northern hybridizations and in situ hybridizations. In vitro techniques for detection of an analyte protein include enzyme linked immunosorbent assays (ELISAs), Western blots, immunoprecipitations, and immunofluorescence. In vitro techniques for detection of an analyte genomic DNA include Southern hybridizations. Procedures for conducting immunoassays are described, for example in "ELISA: Theory and Practice: Methods in Molecular Biology", Vol. 42, J. R. Crowther (Ed.) Human Press, Totowa, N.J., 1995; "Immunoassay", E. Diamandis and T. Christopoulus, Academic Press, Inc., San Diego, Calif., 1996; and "Practice and Thory of Enzyme Immunoassays", P. Tijssen, Elsevier Science Publishers, Amsterdam, 1985. Furthermore, in vivo techniques for detection of an analyte protein include introducing into a subject a labeled anti-an analyte protein antibody. For example, the antibody can be labeled with a radioactive marker whose presence and location in a subject can be detected by standard imaging techniques.

NOVX Recombinant Expression Vectors and Host Cells

Another aspect of the invention pertains to vectors, preferably expression vectors, containing a nucleic acid encoding an NOVX protein, or derivatives, fragments, analogs or homologs thereof. As used herein, the term "vector" refers to a nucleic acid molecule capable of transporting another nucleic acid to which it has been linked. One type of vector is a "plasmid", which refers to a circular double stranded DNA loop into which additional DNA segments can be ligated. Another type of vector is a viral vector, wherein additional DNA segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors". In general, expression vectors of utility in recombinant DNA techniques are often in the form of plasmids. In the present specification, "plasmid" and "vector" can be used interchangeably as the plasmid is the most commonly used form of vector. However, the invention is intended to include such other forms of expression vectors, such as viral vectors (e.g., replication defective retroviruses, adenoviruses and adeno-associated viruses), which serve equivalent functions.

The recombinant expression vectors of the invention comprise a nucleic acid of the invention in a form suitable for expression of the nucleic acid in a host cell, which means that the recombinant expression vectors include one or more regulatory sequences, selected on the basis of the host cells to be used for expression, that is operatively-linked to the nucleic acid sequence to be expressed. Within a recombinant expression vector, "operably-linked" is intended to mean that the nucleotide sequence of interest is linked to the regulatory sequence(s) in a manner that allows for expression of the nucleotide sequence (e.g., in an in vitro transcription/translation system or in a host cell when the vector is introduced into the host cell).

The term "regulatory sequence" is intended to includes promoters, enhancers and other expression control elements (e.g., polyadenylation signals). Such regulatory sequences are described, for example, in Goeddel, GENE EXPRESSION TECHNOLOGY: METHODS IN ENZYMOLOGY 185, Academic Press, San Diego, Calif. (1990). Regulatory sequences include those that direct constitutive expression of a nucleotide sequence in many types of host cell and those that direct expression of the nucleotide sequence only in certain host cells (e.g., tissue-specific regulatory sequences). It will be appreciated by those skilled in the art that the design of the expression vector can depend on such factors as the choice of the host cell to be transformed, the level of expression of protein desired, etc. The expression vectors of the invention can be introduced into host cells to thereby produce proteins or peptides, including fusion proteins or peptides, encoded by nucleic acids as described herein (e.g., NOVX proteins, mutant forms of NOVX proteins, fusion proteins, etc.).

The recombinant expression vectors of the invention can be designed for expression of NOVX proteins in prokaryotic or eukaryotic cells. For example, NOVX proteins can be expressed in bacterial cells such as *Escherichia coli*, insect cells (using baculovirus expression vectors) yeast cells or mammalian cells. Suitable host cells are discussed further in Goeddel, GENE EXPRESSION TECHNOLOGY: METHODS IN ENZYMOLOGY 185, Academic Press, San Diego, Calif. (1990). Alternatively, the recombinant expression vector can be transcribed and translated in vitro, for example using T7 promoter regulatory sequences and T7 polymerase.

Expression of proteins in prokaryotes is most often carried out in *Escherichia coli* with vectors containing constitutive or inducible promoters directing the expression of either fusion or non-fusion proteins. Fusion vectors add a number of amino acids to a protein encoded therein, usually to the amino terminus of the recombinant protein. Such fusion vectors typically serve three purposes: (i) to increase expression of recombinant protein; (ii) to increase the solubility of the recombinant protein; and (iii) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase. Typical fusion expression vectors include pGEX (Pharmacia Biotech Inc; Smith and Johnson, 1988. *Gene* 67: 31–40), pMAL (New England Biolabs, Beverly, Mass.) and pRIT5 (Pharmacia, Piscataway, N.J.) that fuse glutathione S-transferase (GST), maltose E binding protein, or protein A, respectively, to the target recombinant protein.

Examples of suitable inducible non-fusion *E. coli* expression vectors include pTrc (Amrann et al., (1988) *Gene* 69:301–315) and pET 11d (Studier et al., GENE EXPRESSION TECHNOLOGY: METHODS IN ENZYMOLOGY 185, Academic Press, San Diego, Calif. (1990) 60–89).

One strategy to maximize recombinant protein expression in *E. coli* is to express the protein in a host bacteria with an impaired capacity to proteolytically cleave the recombinant protein. See, e.g., Gottesman, GENE EXPRESSION TECHNOLOGY: METHODS IN ENZYMOLOGY 185, Academic Press, San Diego, Calif. (1990) 119–128. Another strategy is to alter the nucleic acid sequence of the nucleic acid to be inserted into an expression vector so that the individual codons for each amino acid are those preferentially utilized in *E. coli* (see, e.g., Wada, et al., 1992. *Nucl. Acids Res.* 20: 2111–2118). Such alteration of nucleic acid sequences of the invention can be carried out by standard DNA synthesis techniques.

In another embodiment, the NOVX expression vector is a yeast expression vector. Examples of vectors for expression in yeast *Saccharomyces cerivisae* include pYepSec1 (Baldari, et al., 1987. *EMBO J.* 6: 229–234), pMFa (Kuijan and Herskowitz, 1982. *Cell* 30: 933–943), pJRY88 (Schultz et al., 1987. *Gene* 54: 113–123), pYES2 (Invitrogen Corporation, San Diego, Calif.), and picZ (InVitrogen Corp, San Diego, Calif.).

Alternatively, NOVX can be expressed in insect cells using baculovirus expression vectors. Baculovirus vectors available for expression of proteins in cultured insect cells (e.g., SF9 cells) include the pAc series (Smith, et al., 1983. *Mol. Cell. Biol.* 3: 2156–2165) and the pVL series (Lucklow and Summers, 1989. *Virology* 170: 31–39).

In yet another embodiment, a nucleic acid of the invention is expressed in mammalian cells using a mammalian expression vector. Examples of mammalian expression vectors include pCDM8 (Seed, 1987. *Nature* 329: 840) and pMT2PC (Kaufman, et al., 1987. *EMBO J.* 6: 187–195). When used in mammalian cells, the expression vector's control functions are often provided by viral regulatory elements. For example, commonly used promoters are derived from polyoma, adenovirus 2, cytomegalovirus, and simian virus 40. For other suitable expression systems for both prokaryotic and eukaryotic cells see, e.g., Chapters 16 and 17 of Sambrook, et al., MOLECULAR CLONING: A LABORATORY MANUAL. 2nd ed., Cold Spring Harbor Laboratory, Cold Spring Harbor Laboratory Press, Cold Spring Harbor, N.Y., 1989.

In another embodiment, the recombinant mammalian expression vector is capable of directing expression of the nucleic acid preferentially in a particular cell type (e.g., tissue-specific regulatory elements are used to express the nucleic acid). Tissue-specific regulatory elements are known in the art. Non-limiting examples of suitable tissue-specific promoters include the albumin promoter (liver-specific; Pinkert, et al., 1987. *Genes Dev.* 1: 268–277), lymphoid-specific promoters (Calame and Eaton, 1988. *Adv. Immunol.* 43: 235–275), in particular promoters of T cell receptors (Winoto and Baltimore, 1989. *EMBO J.* 8: 729–733) and immunoglobulins (Baneiji, et al., 1983. *Cell* 33: 729–740; Queen and Baltimore, 1983. *Cell* 33: 741–748), neuron-specific promoters (e.g., the neurofilament promoter; Byrne and Ruddle, 1989. *Proc. Natl. Acad. Sci. USA* 86: 5473–5477), pancreas-specific promoters (Edlund, et al., 1985. *Science* 230: 912–916), and mammary gland-specific promoters (e.g., milk whey promoter; U.S. Pat. No. 4,873, 316 and European Application Publication No. 264,166). Developmentally-regulated promoters are also encompassed, e.g., the murine hox promoters (Kessel and Gruss, 1990. *Science* 249: 374–379) and the □-fetoprotein promoter (Campes and Tilghman, 1989. *Genes Dev.* 3: 537–546).

The invention further provides a recombinant expression vector comprising a DNA molecule of the invention cloned into the expression vector in an antisense orientation. That is, the DNA molecule is operatively-linked to a regulatory sequence in a manner that allows for expression (by transcription of the DNA molecule) of an RNA molecule that is antisense to NOVX mRNA. Regulatory sequences operatively linked to a nucleic acid cloned in the antisense orientation can be chosen that direct the continuous expression of the antisense RNA molecule in a variety of cell types, for instance viral promoters and/or enhancers, or regulatory sequences can be chosen that direct constitutive, tissue specific or cell type specific expression of antisense RNA. The antisense expression vector can be in the form of a recombinant plasmid, phagemid or attenuated virus in which antisense nucleic acids are produced under the control of a high efficiency regulatory region, the activity of which can be determined by the cell type into which the vector is introduced. For a discussion of the regulation of gene expression using antisense genes see, e.g., Weintraub, et al., "Antisense RNA as a molecular tool for genetic analysis," *Reviews-Trends in Genetics*, Vol. 1(1) 1986.

Another aspect of the invention pertains to host cells into which a recombinant expression vector of the invention has been introduced. The terms "host cell" and "recombinant host cell" are used interchangeably herein. It is understood that such terms refer not only to the particular subject cell but also to the progeny or potential progeny of such a cell. Because certain modifications may occur in succeeding generations due to either mutation or environmental influences, such progeny may not, in fact, be identical to the parent cell, but are still included within the scope of the term as used herein.

A host cell can be any prokaryotic or eukaryotic cell. For example, NOVX protein can be expressed in bacterial cells such as *E. coli*, insect cells, yeast or mammalian cells (such as Chinese hamster ovary cells (CHO) or COS cells). Other suitable host cells are known to those skilled in the art.

Vector DNA can be introduced into prokaryotic or eukaryotic cells via conventional transformation or transfection techniques. As used herein, the terms "transformation" and "transfection" are intended to refer to a variety of art-recognized techniques for introducing foreign nucleic acid (e.g., DNA) into a host cell, including calcium phosphate or calcium chloride co-precipitation, DEAE-dextran-mediated transfection, lipofection, or electroporation. Suitable methods for transforming or transfecting host cells can be found in Sambrook, et al. (MOLECULAR CLONING: A LABORATORY MANUAL. 2nd ed., Cold Spring Harbor Laboratory, Cold Spring Harbor Laboratory Press, Cold Spring Harbor, N.Y., 1989), and other laboratory manuals.

For stable transfection of mammalian cells, it is known that, depending upon the expression vector and transfection technique used, only a small fraction of cells may integrate the foreign DNA into their genome. In order to identify and select these integrants, a gene that encodes a selectable marker (e.g., resistance to antibiotics) is generally introduced into the host cells along with the gene of interest. Various selectable markers include those that confer resistance to drugs, such as G418, hygromycin and methotrexate. Nucleic acid encoding a selectable marker can be introduced into a host cell on the same vector as that encoding NOVX or can be introduced on a separate vector. Cells stably transfected with the introduced nucleic acid can be identified by drug selection (e.g., cells that have incorporated the selectable marker gene will survive, while the other cells die).

A host cell of the invention, such as a prokaryotic or eukaryotic host cell in culture, can be used to produce (i.e., express) NOVX protein. Accordingly, the invention further provides methods for producing NOVX protein using the host cells of the invention. In one embodiment, the method comprises culturing the host cell of invention (into which a recombinant expression vector encoding NOVX protein has been introduced) in a suitable medium such that NOVX protein is produced. In another embodiment, the method further comprises isolating NOVX protein from the medium or the host cell.

Transgenic NOVX Animals

The host cells of the invention can also be used to produce non-human transgenic animals. For example, in one embodiment, a host cell of the invention is a fertilized oocyte or an embryonic stem cell into which NOVX protein-coding sequences have been introduced. Such host cells can then be used to create non-human transgenic animals in which exogenous NOVX sequences have been introduced into their genome or homologous recombinant animals in which endogenous NOVX sequences have been altered. Such animals are useful for studying the function and/or activity of NOVX protein and for identifying and/or evaluating modulators of NOVX protein activity. As used herein, a "transgenic animal" is a non-human animal, preferably a mammal, more preferably a rodent such as a rat or mouse, in which one or more of the cells of the animal includes a transgene. Other examples of transgenic animals include non-human primates, sheep, dogs, cows, goats, chickens, amphibians, etc. A transgene is exogenous DNA that is integrated into the genome of a cell from which a transgenic animal develops and that remains in the genome of the mature animal, thereby directing the expression of an encoded gene product in one or more cell types or tissues of the transgenic animal. As used herein, a "homologous recombinant animal" is a non-human animal, preferably a mammal, more preferably a mouse, in which an endogenous NOVX gene has been altered by homologous recombination between the endogenous gene and an exogenous DNA molecule introduced into a cell of the animal, e.g., an embryonic cell of the animal, prior to development of the animal.

A transgenic animal of the invention can be created by introducing NOVX-encoding nucleic acid into the male pronuclei of a fertilized oocyte (e.g., by microinjection, retroviral infection) and allowing the oocyte to develop in a pseudopregnant female foster animal. The human NOVX cDNA sequences SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 64, 66, 68, 70, 72, 74, 76, 78, 80, 82, 84, 86, 88, 90, 92, 94, 96, 98, 100, 102, 104, 106, 108, 110, 112, 114, 116, 118, 120, and 122 can be introduced as a transgene into the genome of a non-human animal. Alternatively, a non-human homologue of the human NOVX gene, such as a mouse NOVX gene, can be isolated based on hybridization to the human NOVX cDNA (described further supra) and used as a transgene. Intronic sequences and polyadenylation signals can also be included in the transgene to increase the efficiency of expression of the transgene. A tissue-specific regulatory sequence(s) can be operably-linked to the NOVX transgene to direct expression of NOVX protein to particular cells. Methods for generating transgenic animals via embryo manipulation and microinjection, particularly animals such as mice, have become conventional in the art and are described, for example, in U.S. Pat. Nos. 4,736,866; 4,870,009; and 4,873,191; and Hogan, 1986. In: MANIPULATING THE MOUSE EMBRYO, Cold Spring Harbor Laboratory Press, Cold Spring Harbor, N.Y. Similar methods are used for production of other transgenic animals. A transgenic founder animal can be identified based upon the presence of the NOVX transgene in its genome and/or expression of NOVX mRNA in tissues or cells of the animals. A transgenic founder animal can then be used to breed additional animals carrying the transgene. Moreover, transgenic animals carrying a transgene-encoding NOVX protein can further be bred to other transgenic animals carrying other transgenes.

To create a homologous recombinant animal, a vector is prepared which contains at least a portion of an NOVX gene into which a deletion, addition or substitution has been introduced to thereby alter, e.g., functionally disrupt, the NOVX gene. The NOVX gene can be a human gene (e.g., the cDNA of SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 64, 66, 68, 70, 72, 74, 76, 78, 80, 82, 84, 86, 88, 90, 92, 94, 96, 98, 100, 102, 104, 106, 108, 110, 112, 114, 116, 118, 120, and 122), but more preferably, is a non-human homologue of a human NOVX gene. For example, a mouse homologue of human NOVX gene of SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 64, 66, 68, 70, 72, 74, 76, 78, 80, 82, 84, 86, 88, 90, 92, 94, 96, 98, 100, 102, 104, 106, 108, 110, 112, 114, 116, 118, 120, and 122 can be used to construct a homologous recombination vector suitable for altering an endogenous NOVX gene in the mouse genome. In one embodiment, the vector is designed such that, upon homologous recombination, the endogenous NOVX gene is functionally disrupted (i.e., no longer encodes a functional protein; also referred to as a "knock out" vector).

Alternatively, the vector can be designed such that, upon homologous recombination, the endogenous NOVX gene is mutated or otherwise altered but still encodes functional protein (e.g., the upstream regulatory region can be altered to thereby alter the expression of the endogenous NOVX protein). In the homologous recombination vector, the altered portion of the NOVX gene is flanked at its 5'- and 3'-termini by additional nucleic acid of the NOVX gene to allow for homologous recombination to occur between the exogenous NOVX gene carried by the vector and an endogenous NOVX gene in an embryonic stem cell. The additional flanking NOVX nucleic acid is of sufficient length for successful homologous recombination with the endogenous gene. Typically, several kilobases of flanking DNA (both at the 5'- and 3'-termini) are included in the vector. See, e.g., Thomas, et al., 1987. *Cell* 51: 503 for a description of homologous recombination vectors. The vector is ten introduced into an embryonic stem cell line (e.g., by electroporation) and cells in which the introduced NOVX gene has homologously-recombined with the endogenous NOVX gene are selected. See, e.g. Li, et al., 1992. *Cell* 69: 915.

The selected cells are then injected into a blastocyst of an animal (e.g., a mouse) to form aggregation chimeras. See, e.g., Bradley, 1987. In: TERATOCARCINOMAS AND EMBRYONIC STEM CELLS: A PRACTICAL APPROACH, Robertson, ed. IRL, Oxford, pp. 113–152. A chimeric embryo can then be implanted into a suitable pseudopregnant female foster animal and the embryo brought to term. Progeny harboring the homologously-recombined DNA in their germ cells can be used to breed animals in which all cells of the animal contain the homologously-recombined DNA by germline transmission of the transgene. Methods for constructing homologous recombination vectors and homologous recombinant animals are described further in Bradley, 1991. *Curr. Opin. Biotechnol.* 2: 823–829; PCT International Publication Nos.: WO 90/11354; WO 91/01140; WO 92/0968; and WO 93/04169.

In another embodiment, transgenic non-humans animals can be produced that contain selected systems that allow for regulated expression of the transgene. One example of such a system is the cre/loxP recombinase system of bacteriophage P1. For a description of the cre/loxP recombinase system, See, e.g., Lakso, et al., 1992. *Proc. Natl. Acad. Sci. USA* 89: 6232–6236. Another example of a recombinase system is the FLP recombinase system of *Saccharomyces cerevisiae*. See, O'Gorman, et al., 1991. *Science* 251:1351–1355. If a cre/loxP recombinase system is used to regulate expression of the transgene, animals containing transgenes encoding both the Cre recombinase and a selected protein are required. Such animals can be provided through the construction of "double" transgenic animals, e.g., by mating two transgenic animals, one containing a transgene encoding a selected protein and the other containing a transgene encoding a recombinase.

Clones of the non-human transgenic animals described herein can also be produced according to the methods described in Wilmut, et al., 1997. *Nature* 385: 810–813. In brief, a cell (e.g., a somatic cell) from the transgenic animal can be isolated and induced to exit the growth cycle and enter $G_0$ phase. The quiescent cell can then be fused, e.g., through the use of electrical pulses, to an enucleated oocyte from an animal of the same species from which the quiescent cell is isolated. The reconstructed oocyte is then cultured such that it develops to morula or blastocyte and then transferred to pseudopregnant female foster animal. The offspring borne of this female foster animal will be a clone of the animal from which the cell (e.g., the somatic cell) is isolated.

Pharmaceutical Compositions

The NOVX nucleic acid molecules, NOVX proteins, and anti-NOVX antibodies (also referred to herein as "active compounds") of the invention, and derivatives, fragments, analogs and homologs thereof, can be incorporated into pharmaceutical compositions suitable for administration. Such compositions typically comprise the nucleic acid molecule, protein, or antibody and a pharmaceutically acceptable carrier. As used herein, "pharmaceutically acceptable carrier" is intended to include any and all solvents, dispersion media, coatings, antibacterial and antifungal agents, isotonic and absorption delaying agents, and the like, compatible with pharmaceutical administration. Suitable carriers are described in the most recent edition of Remington's Pharmaceutical Sciences, a standard reference text in the field, which is incorporated herein by reference. Preferred examples of such carriers or diluents include, but are not limited to, water, saline, finger's solutions, dextrose solution, and 5% human serum albumin. Liposomes and non-aqueous vehicles such as fixed oils may also be used. The use of such media and agents for pharmaceutically active substances is well known in the art. Except insofar as any conventional media or agent is incompatible with the active compound, use thereof in the compositions is contemplated. Supplementary active compounds can also be incorporated into the compositions.

A pharmaceutical composition of the invention is formulated to be compatible with its intended route of administration. Examples of routes of administration include parenteral, e.g., intravenous, intradermal, subcutaneous, oral (e.g., inhalation), transdermal (i.e., topical), transmucosal, and rectal administration. Solutions or suspensions used for parenteral, intradermal, or subcutaneous application can include the following components: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; chelating agents such as ethylenediaminetetraacetic acid (EDTA); buffers such as acetates, citrates or phosphates, and agents for the adjustment of tonicity such as sodium chloride or dextrose. The pH can be adjusted with acids or bases, such as hydrochloric acid or sodium hydroxide. The parenteral preparation can be enclosed in ampoules, disposable syringes or multiple dose vials made of glass or plastic.

Pharmaceutical compositions suitable for injectable use include sterile aqueous solutions (where water soluble) or dispersions and sterile powders for the extemporaneous preparation of sterile injectable solutions or dispersion. For intravenous administration, suitable carriers include physiological saline, bacteriostatic water, Cremophor EL™ (BASF, Parsippany, N.J.) or phosphate buffered saline (PBS). In all cases, the composition must be sterile and should be fluid to the extent that easy syringeability exists. It must be stable under the conditions of manufacture and storage and must be preserved against the contaminating action of microorganisms such as bacteria and fungi. The carrier can be a solvent or dispersion medium containing, for example, water, ethanol, polyol (for example, glycerol, propylene glycol, and liquid polyethylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, it will be preferable to include isotonic agents, for example, sugars, polyalcohols such as manitol, sorbitol, sodium chloride in the composition. Prolonged absorption of the injectable compositions can be brought about by including in the composition an agent which delays absorption, for example, aluminum monostearate and gelatin.

Sterile injectable solutions can be prepared by incorporating the active compound (e.g., an NOVX protein or anti-NOVX antibody) in the required amount in an appropriate solvent with one or a combination of ingredients enumerated above, as required, followed by filtered sterilization. Generally, dispersions are prepared by incorporating the active compound into a sterile vehicle that contains a basic dispersion medium and the required other ingredients from those enumerated above. In the case of sterile powders for the preparation of sterile injectable solutions, methods of preparation are vacuum drying and freeze-drying that yields a powder of the active ingredient plus any additional desired ingredient from a previously sterile-filtered solution thereof.

Oral compositions generally include an inert diluent or an edible carrier. They can be enclosed in gelatin capsules or compressed into tablets. For the purpose of oral therapeutic administration, the active compound can be incorporated with excipients and used in the form of tablets, troches, or capsules. Oral compositions can also be prepared using a fluid carrier for use as a mouthwash, wherein the compound in the fluid carrier is applied orally and swished and expectorated or swallowed. Pharmaceutically compatible binding agents, and/or adjuvant materials can be included as part of the composition. The tablets, pills, capsules, troches and the like can contain any of the following ingredients, or compounds of a similar nature: a binder such as microcrystalline cellulose, gum tragacanth or gelatin; an excipient such as starch or lactose, a disintegrating agent such as alginic acid, Primogel, or corn starch; a lubricant such as magnesium stearate or Sterotes; a glidant such as colloidal silicon dioxide; a sweetening agent such as sucrose or saccharin; or a flavoring agent such as peppermint, methyl salicylate, or orange flavoring.

For administration by inhalation, the compounds are delivered in the form of an aerosol spray from pressured container or dispenser which contains a suitable propellant, e.g., a gas such as carbon dioxide, or a nebulizer.

Systemic administration can also be by transmucosal or transdermal means. For transmucosal or transdermal administration, penetrants appropriate to the barrier to be permeated are used in the formulation. Such penetrants are generally known in the art, and include, for example, for transmucosal administration, detergents, bile salts, and fusidic acid derivatives. Transmucosal administration can be accomplished through the use of nasal sprays or suppositories. For transdermal administration, the active compounds are formulated into ointments, salves, gels, or creams as generally known in the art.

The compounds can also be prepared in the form of suppositories (e.g., with conventional suppository bases such as cocoa butter and other glycerides) or retention enemas for rectal delivery.

In one embodiment, the active compounds are prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Methods for preparation of such formulations will be apparent to those skilled in the art. The materials can also be obtained commercially from Alza Corporation and Nova Pharmaceuticals, Inc. Liposomal suspensions (including liposomes targeted to infected cells with monoclonal antibodies to viral antigens) can also be used as pharmaceutically acceptable carriers. These can be prepared according to methods known to those skilled in the art, for example, as described in U.S. Pat. No. 4,522,811.

It is especially advantageous to formulate oral or parenteral compositions in dosage unit form for ease of administration and uniformity of dosage. Dosage unit form as used herein refers to physically discrete units suited as unitary dosages for the subject to be treated; each unit containing a predetermined quantity of active compound calculated to produce the desired therapeutic effect in association with the required pharmaceutical carrier. The specification for the dosage unit forms of the invention are dictated by and directly dependent on the unique characteristics of the active compound and the particular therapeutic effect to be achieved, and the limitations inherent in the art of compounding such an active compound for the treatment of individuals.

The nucleic acid molecules of the invention can be inserted into vectors and used as gene therapy vectors. Gene therapy vectors can be delivered to a subject by, for example, intravenous injection, local administration (see, e.g., U.S. Pat. No. 5,328,470) or by stereotactic injection (see, e.g., Chen, et al., 1994. *Proc. Natl. Acad. Sci. USA* 91: 3054–3057). The pharmaceutical preparation of the gene therapy vector can include the gene therapy vector in an acceptable diluent, or can comprise a slow release matrix in which the gene delivery vehicle is imbedded. Alternatively, where the complete gene delivery vector can be produced intact from recombinant cells, e.g., retroviral vectors, the pharmaceutical preparation can include one or more cells that produce the gene delivery system.

The pharmaceutical compositions can be included in a container, pack, or dispenser together with instructions for administration.

Screening and Detection Methods

The isolated nucleic acid molecules of the invention can be used to express NOVX protein (e.g., via a recombinant expression vector in a host cell in gene therapy applications), to detect NOVX mRNA (e.g., in a biological sample) or a genetic lesion in an NOVX gene, and to modulate NOVX activity, as described further, below. In addition, the NOVX proteins can be used to screen drugs or compounds that modulate the NOVX protein activity or expression as well as to treat disorders characterized by insufficient or excessive production of NOVX protein or production of NOVX protein forms that have decreased or aberrant activity compared to NOVX wild-type protein (e.g.; diabetes (regulates insulin release); obesity (binds and transport lipids); metabolic disturbances associated with obesity, the metabolic syndrome X as well as anorexia and wasting disorders associated with chronic diseases and various cancers, and infectious disease (possesses anti-microbial activity) and the various dyslipidemias. In addition, the anti-NOVX antibodies of the invention can be used to detect and isolate NOVX proteins and modulate NOVX activity. In yet a further aspect, the invention can be used in methods to influence appetite, absorption of nutrients and the disposition of metabolic substrates in both a positive and negative fashion.

The invention further pertains to novel agents identified by the screening assays described herein and uses thereof for treatments as described, supra.

Screening Assays

The invention provides a method (also referred to herein as a "screening assay") for identifying modulators, i.e., candidate or test compounds or agents (e.g., peptides, peptidomimetics, small molecules or other drugs) that bind to NOVX proteins or have a stimulatory or inhibitory effect on, e.g., NOVX protein expression or NOVX protein activity. The invention also includes compounds identified in the screening assays described herein.

In one embodiment, the invention provides assays for screening candidate or test compounds which bind to or modulate the activity of the membrane-bound form of an NOVX protein or polypeptide or biologically-active portion thereof. The test compounds of the invention can be obtained using any of the numerous approaches in combinatorial library methods known in the art, including: biological libraries; spatially addressable parallel solid phase or solution phase libraries; synthetic library methods requiring deconvolution; the "one-bead one-compound" library method; and synthetic library methods using affinity chromatography selection. The biological library approach is limited to peptide libraries, while the other four approaches are applicable to peptide, non-peptide oligomer or small molecule libraries of compounds. See, e.g., Lam, 1997. *Anticancer Drug Design* 12: 145.

A "small molecule" as used herein, is meant to refer to a composition that has a molecular weight of less than about 5 kD and most preferably less than about 4 kD. Small molecules can be, e.g., nucleic acids, peptides, polypeptides, peptidomimetics, carbohydrates, lipids or other organic or inorganic molecules. Libraries of chemical and/or biological mixtures, such as fungal, bacterial, or algal extracts, are known in the art and can be screened with any of the assays of the invention.

Examples of methods for the synthesis of molecular libraries can be found in the art, for example in: DeWitt, et al., 1993. *Proc. Natl. Acad. Sci. U.S.A.* 90: 6909; Erb, et al., 1994. *Proc. Natl. Acad. Sci. U.S.A.* 91: 11422; Zuckermann, et al., 1994. *J. Med. Chem.* 37: 2678; Cho, et al., 1993. *Science* 261: 1303; Carrell, et al., 1994. *Angew. Chem. Int. Ed. Engl.* 33: 2059; Carell, et al., 1994. *Angew. Chem. Int. Ed. Engl.* 33: 2061; and Gallop, et al., 1994. *J. Med. Chem.* 37: 1233.

Libraries of compounds may be presented in solution (e.g., Houghten, 1992. *Biotechniques* 13: 412–421), or on beads (Lam, 1991. *Nature* 354: 82–84), on chips (Fodor, 1993. *Nature* 364: 555–556), bacteria (Ladner, U.S. Pat. No. 5,223,409), spores (Ladner, U.S. Pat. No. 5,233,409), plasmids (Cull, et al., 1992. *Proc. Natl. Acad. Sci. USA* 89: 1865–1869) or on phage (Scott and Smith, 1990. *Science* 249: 386–390; Devlin, 1990. *Science* 249: 404–406; Cwirla, et al., 1990. *Proc. Natl. Acad. Sci. U.S.A.* 87: 6378–6382; Felici, 1991. *J. Mol. Biol.* 222: 301–310; Ladner, U.S. Pat. No. 5,233,409.).

In one embodiment, an assay is a cell-based assay in which a cell which expresses a membrane-bound form of NOVX protein, or a biologically-active portion thereof, on the cell surface is contacted with a test compound and the ability of the test compound to bind to an NOVX protein determined. The cell, for example, can of mammalian origin or a yeast cell. Determining the ability of the test compound to bind to the NOVX protein can be accomplished, for example, by coupling the test compound with a radioisotope or enzymatic label such that binding of the test compound to the NOVX protein or biologically-active portion thereof can be determined by detecting the labeled compound in a complex. For example, test compounds can be labeled with $^{125}I$, $^{35}S$, $^{14}C$, or $^{3}H$, either directly or indirectly, and the radioisotope detected by direct counting of radioemission or by scintillation counting. Alternatively, test compounds can be enzymatically-labeled with, for example, horseradish peroxidase, alkaline phosphatase, or luciferase, and the enzymatic label detected by determination of conversion of an appropriate substrate to product. In one embodiment, the assay comprises contacting a cell which expresses a membrane-bound form of NOVX protein, or a biologically-active portion thereof, on the cell surface with a known compound which binds NOVX to form an assay mixture, contacting the assay mixture with a test compound, and determining the ability of the test compound to interact with an NOVX protein, wherein determining the ability of the test compound to interact with an NOVX protein comprises determining the ability of the test compound to preferentially bind to NOVX protein or a biologically-active portion thereof as compared to the known compound.

In another embodiment, an assay is a cell-based assay comprising contacting a cell expressing a membrane-bound form of NOVX protein, or a biologically-active portion thereof, on the cell surface with a test compound and determining the ability of the test compound to modulate (e.g., stimulate or inhibit) the activity of the NOVX protein or biologically-active portion thereof. Determining the ability of the test compound to modulate the activity of NOVX or a biologically-active portion thereof can be accomplished, for example, by determining the ability of the NOVX protein to bind to or interact with an NOVX target molecule. As used herein, a "target molecule" is a molecule with which an NOVX protein binds or interacts in nature, for example, a molecule on the surface of a cell which expresses an NOVX interacting protein, a molecule on the surface of a second cell, a molecule in the extracellular milieu, a molecule associated with the internal surface of a cell membrane or a cytoplasmic molecule. An NOVX target molecule can be a non-NOVX molecule or an NOVX protein or polypeptide of the invention. In one embodiment, an NOVX target molecule is a component of a signal transduction pathway that facilitates transduction of an extracellular signal (e.g. a signal generated by binding of a compound to a membrane-bound NOVX molecule) through the cell membrane and into the cell. The target, for example, can be a second intercellular protein that has catalytic activity or a protein that facilitates the association of downstream signaling molecules with NOVX.

Determining the ability of the NOVX protein to bind to or interact with an NOVX target molecule can be accomplished by one of the methods described above for determining direct binding. In one embodiment, determining the ability of the NOVX protein to bind to or interact with an NOVX target molecule can be accomplished by determining the activity of the target molecule. For example, the activity of the target molecule can be determined by detecting induction of a cellular second messenger of the target (i.e. intracellular $Ca^{2+}$, diacylglycerol, $IP_3$, etc.), detecting catalytic/enzymatic activity of the target an appropriate substrate, detecting the induction of a reporter gene (comprising an NOVX-responsive regulatory element operatively linked to a nucleic acid encoding a detectable marker, e.g., luciferase), or detecting a cellular response, for example, cell survival, cellular differentiation, or cell proliferation.

In yet another embodiment, an assay of the invention is a cell-free assay comprising contacting an NOVX protein or biologically-active portion thereof with a test compound and determining the ability of the test compound to bind to the NOVX protein or biologically-active portion thereof. Binding of the test compound to the NOVX protein can be determined either directly or indirectly as described above. In one such embodiment, the assay comprises contacting the NOVX protein or biologically-active portion thereof with a known compound which binds NOVX to form an assay mixture, contacting the assay mixture with a test compound, and determining the ability of the test compound to interact with an NOVX protein, wherein determining the ability of the test compound to interact with an NOVX protein comprises determining the ability of the test compound to preferentially bind to NOVX or biologically-active portion thereof as compared to the known compound.

In still another embodiment, an assay is a cell-free assay comprising contacting NOVX protein or biologically-active portion thereof with a test compound and determining the ability of the test compound to modulate (e.g. stimulate or inhibit) the activity of the NOVX protein or biologically-active portion thereof. Determining the ability of the test compound to modulate the activity of NOVX can be accomplished, for example, by determining the ability of the NOVX protein to bind to an NOVX target molecule by one of the methods described above for determining direct binding. In an alternative embodiment, determining the ability of the test compound to modulate the activity of NOVX protein can be accomplished by determining the ability of the NOVX protein further modulate an NOVX target molecule. For example, the catalytic/enzymatic activity of the target molecule on an appropriate substrate can be determined as described, supra.

In yet another embodiment, the cell-free assay comprises contacting the NOVX protein or biologically-active portion thereof with a known compound which binds NOVX protein to form an assay mixture, contacting the assay mixture with a test compound, and determining the ability of the test compound to interact with an NOVX protein, wherein determining the ability of the test compound to interact with an NOVX protein comprises determining the ability of the NOVX protein to preferentially bind to or modulate the activity of an NOVX target molecule.

The cell-free assays of the invention are amenable to use of both the soluble form or the membrane-bound form of NOVX protein. In the case of cell-free assays comprising the membrane-bound form of NOVX protein, it may be desirable to utilize a solubilizing agent such that the membrane-bound form of NOVX protein is maintained in solution. Examples of such solubilizing agents include non-ionic detergents such as n-octylglucoside, n-dodecylglucoside, n-dodecylmaltoside, octanoyl-N-methylglucamide, decanoyl-N-methylglucamide, Triton® X-100, Triton® X-114, Thesit®, Isotridecypoly(ethylene glycol ether)$_n$, N-dodecyl-N,N-dimethyl-3-ammonio-1-propane sulfonate, 3-(3-cholamidopropyl) dimethylamminiol-1-propane sulfonate (CHAPS), or 3-(3-cholamidopropyl)dimethylamminiol-2-hydroxy-1-propane sulfonate (CHAPSO).

In more than one embodiment of the above assay methods of the invention, it may be desirable to immobilize either NOVX protein or its target molecule to facilitate separation of complexed from uncomplexed forms of one or both of the proteins, as well as to accommodate automation of the assay. Binding of a test compound to NOVX protein, or interaction of NOVX protein with a target molecule in the presence and absence of a candidate compound, can be accomplished in any vessel suitable for containing the reactants. Examples of such vessels include microtiter plates, test tubes, and microcentrifuge tubes. In one embodiment, a fusion protein can be provided that adds a domain that allows one or both of the proteins to be bound to a matrix. For example, GST-NOVX fusion proteins or GST-target fusion proteins can be adsorbed onto glutathione sepharose beads (Sigma Chemical, St. Louis, Mo.) or glutathione derivatized microtiter plates, that are then combined with the test compound or the test compound and either the non-adsorbed target protein or NOVX protein, and the mixture is incubated under conditions conducive to complex formation (e.g., at physiological conditions for salt and pH). Following incubation, the beads or microtiter plate wells are washed to remove any unbound components, the matrix immobilized in the case of beads, complex determined either directly or indirectly, for example, as described, supra. Alternatively, the complexes can be dissociated from the matrix, and the level of NOVX protein binding or activity determined using standard techniques.

Other techniques for immobilizing proteins on matrices can also be used in the screening assays of the invention. For example, either the NOVX protein or its target molecule can be immobilized utilizing conjugation of biotin and streptavidin. Biotinylated NOVX protein or target molecules can be prepared from biotin-NHS (N-hydroxy-succinimide) using techniques well-known within the art (e.g., biotinylation kit, Pierce Chemicals, Rockford, Ill.), and immobilized in the wells of streptavidin-coated 96 well plates (Pierce Chemical). Alternatively, antibodies reactive with NOVX protein or target molecules, but which do not interfere with binding of the NOVX protein to its target molecule, can be derivatized to the wells of the plate, and unbound target or NOVX protein trapped in the wells by antibody conjugation. Methods for detecting such complexes, in addition to those described above for the GST-immobilized complexes, include immunodetection of complexes using antibodies reactive with the NOVX protein or target molecule, as well as enzyme-linked assays that rely on detecting an enzymatic activity associated with the NOVX protein or target molecule.

In another embodiment, modulators of NOVX protein expression are identified in a method wherein a cell is contacted with a candidate compound and the expression of NOVX mRNA or protein in the cell is determined. The level of expression of NOVX mRNA or protein in the presence of the candidate compound is compared to the level of expression of NOVX mRNA or protein in the absence of the candidate compound. The candidate compound can then be identified as a modulator of NOVX mRNA or protein expression based upon this comparison. For example, when expression of NOVX mRNA or protein is greater (i.e., statistically significantly greater) in the presence of the candidate compound than in its absence, the candidate compound is identified as a stimulator of NOVX mRNA or protein expression. Alternatively, when expression of NOVX mRNA or protein is less (statistically significantly less) in the presence of the candidate compound than in its absence, the candidate compound is identified as an inhibitor of NOVX mRNA or protein expression. The level of NOVX mRNA or protein expression in the cells can be determined by methods described herein for detecting NOVX mRNA or protein.

In yet another aspect of the invention, the NOVX proteins can be used as "bait proteins" in a two-hybrid assay or three hybrid assay (see, e.g., U.S. Pat. No. 5,283,317; Zervos, et al., 1993. *Cell* 72: 223–232; Madura, et al., 1993. *J. Biol. Chem.* 268: 12046–12054; Bartel, et al., 1993. *Biotechniques* 14: 920–924; Iwabuchi, et al., 1993. *Oncogene* 8: 1693–1696; and Brent WO 94/10300), to identify other proteins that bind to or interact with NOVX ("NOVX-binding proteins" or "NOVX-bp") and modulate NOVX activity. Such NOVX-binding proteins are also likely to be involved in the propagation of signals by the NOVX proteins as, for example, upstream or downstream elements of the NOVX pathway.

The two-hybrid system is based on the modular nature of most transcription factors, which consist of separable DNA-binding and activation domains. Briefly, the assay utilizes two different DNA constructs. In one construct, the gene that codes for NOVX is fused to a gene encoding the DNA binding domain of a known transcription factor (e.g., GAL-4). In the other construct, a DNA sequence, from a library of DNA sequences, that encodes an unidentified protein ("prey" or "sample") is fused to a gene that codes for the activation domain of the known transcription factor. If the "bait" and the "prey" proteins are able to interact, in vivo, forming an NOVX-dependent complex, the DNA-binding and activation domains of the transcription factor are brought into close proximity. This proximity allows transcription of a reporter gene (e.g., LacZ) that is operably linked to a transcriptional regulatory site responsive to the transcription factor. Expression of the reporter gene can be detected and cell colonies containing the functional transcription factor can be isolated and used to obtain the cloned gene that encodes the protein which interacts with NOVX.

The invention further pertains to novel agents identified by the aforementioned screening assays and uses thereof for treatments as described herein.

Detection Assays

Portions or fragments of the cDNA sequences identified herein (and the corresponding complete gene sequences) can be used in numerous ways as polynucleotide reagents. By way of example, and not of limitation, these sequences can be used to: (i) map their respective genes on a chromosome; and, thus, locate gene regions associated with genetic disease; (ii) identify an individual from a minute biological sample (tissue typing); and (iii) aid in forensic identification of a biological sample. Some of these applications are described in the subsections, below.

Chromosome Mapping

Once the sequence (or a portion of the sequence) of a gene has been isolated, this sequence can be used to map the location of the gene on a chromosome. This process is called chromosome mapping. Accordingly, portions or fragments of the NOVX sequences, SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 64, 66, 68, 70, 72, 74, 76, 78, 80, 82, 84, 86, 88, 90, 92, 94, 96, 98, 100, 102, 104, 106, 108, 110, 112, 114, 116, 118, 120, and 122, or fragments or derivatives thereof, can be used to map the location of the NOVX genes, respectively, on a chromosome. The mapping of the NOVX sequences to chromosomes is an important first step in correlating these sequences with genes associated with disease.

Briefly, NOVX genes can be mapped to chromosomes by preparing PCR primers (preferably 15–25 bp in length) from the NOVX sequences. Computer analysis of the NOVX, sequences can be used to rapidly select primers that do not span more than one exon in the genomic DNA, thus complicating the amplification process. These primers can then be used for PCR screening of somatic cell hybrids containing individual human chromosomes. Only those hybrids containing the human gene corresponding to the NOVX sequences will yield an amplified fragment.

Somatic cell hybrids are prepared by fusing somatic cells from different mammals (e.g., human and mouse cells). As hybrids of human and mouse cells grow and divide, they gradually lose human chromosomes in random order, but retain the mouse chromosomes. By using media in which mouse cells cannot grow, because they lack a particular enzyme, but in which human cells can, the one human chromosome that contains the gene encoding the needed enzyme will be retained. By using various media, panels of hybrid cell lines can be established. Each cell line in a panel contains either a single human chromosome or a small number of human chromosomes, and a full set of mouse chromosomes, allowing easy mapping of individual genes to specific human chromosomes. See, e.g., D'Eustachio, et al., 1983. *Science* 220: 919–924. Somatic cell hybrids containing only fragments of human chromosomes can also be produced by using human chromosomes with translocations and deletions.

PCR mapping of somatic cell hybrids is a rapid procedure for assigning a particular sequence to a particular chromosome. Three or more sequences can be assigned per day using a single thermal cycler. Using the NOVX sequences to design oligonucleotide primers, sub-localization can be achieved with panels of fragments from specific chromosomes.

Fluorescence in situ hybridization (FISH) of a DNA sequence to a metaphase chromosomal spread can further be used to provide a precise chromosomal location in one step. Chromosome spreads can be made using cells whose division has been blocked in metaphase by a chemical like colcemid that disrupts the mitotic spindle. The chromosomes can be treated briefly with trypsin, and then stained with Giemsa. A pattern of light and dark bands develops on each chromosome, so that the chromosomes can be identified individually. The FISH technique can be used with a DNA sequence as short as 500 or 600 bases. However, clones larger than 1,000 bases have a higher likelihood of binding to a unique chromosomal location with sufficient signal intensity for simple detection. Preferably 1,000 bases, and more preferably 2,000 bases, will suffice to get good results at a reasonable amount of time. For a review of this technique, see, Verma, et al., HUMAN CHROMOSOMES: A MANUAL OF BASIC TECHNIQUES (Pergamon Press, New York 1988).

Reagents for chromosome mapping can be used individually to mark a single chromosome or a single site on that chromosome, or panels of reagents can be used for marking multiple sites and/or multiple chromosomes. Reagents corresponding to noncoding regions of the genes actually are preferred for mapping purposes. Coding sequences are more likely to be conserved within gene families, thus increasing the chance of cross hybridizations during chromosomal mapping.

Once a sequence has been mapped to a precise chromosomal location, the physical position of the sequence on the chromosome can be correlated with genetic map data. Such data are found, e.g., in McKusick, MENDELIAN INHERITANCE IN MAN, available on-line through Johns Hopkins University Welch Medical Library). The relationship between genes and disease, mapped to the same chromosomal region, can then be identified through linkage analysis (co-inheritance of physically adjacent genes), described in, e.g., Egeland, et al., 1987. *Nature,* 325: 783–787.

Moreover, differences in the DNA sequences between individuals affected and unaffected with a disease associated with the NOVX gene, can be determined. If a mutation is observed in some or all of the affected individuals but not in any unaffected individuals, then the mutation is likely to be the causative agent of the particular disease. Comparison of affected and unaffected individuals generally involves first looking for structural alterations in the chromosomes, such as deletions or translocations that are visible from chromosome spreads or detectable using PCR based on that DNA sequence. Ultimately, complete sequencing of genes from several individuals can be performed to confirm the presence of a mutation and to distinguish mutations from polymorphisms.

Tissue Typing

The NOVX sequences of the invention can also be used to identify individuals from minute biological samples. In this technique, an individual's genomic DNA is digested with one or more restriction enzymes, and probed on a Southern blot to yield unique bands for identification. The sequences of the invention are useful as additional DNA markers for RFLP ("restriction fragment length polymorphisms," described in U.S. Pat. No. 5,272,057).

Furthermore, the sequences of the invention can be used to provide an alternative technique that determines the actual base-by-base DNA sequence of selected portions of an individual's genome. Thus, the NOVX sequences described herein can be used to prepare two PCR primers from the 5'- and 3'-termini of the sequences. These primers can then be used to amplify an individual's DNA and subsequently sequence it.

Panels of corresponding DNA sequences from individuals, prepared in this manner, can provide unique individual identifications, as each individual will have a unique set of such DNA sequences due to allelic differences. The sequences of the invention can be used to obtain such identification sequences from individuals and from tissue. The NOVX sequences of the invention uniquely represent portions of the human genome. Allelic variation occurs to some degree in the coding regions of these sequences, and to a greater degree in the noncoding regions. It is estimated that allelic variation between individual humans occurs with a frequency of about once per each 500 bases. Much of the allelic variation is due to single nucleotide polymorphisms (SNPs), which include restriction fragment length polymorphisms (RFLPs).

Each of the sequences described herein can, to some degree, be used as a standard against which DNA from an individual can be compared for identification purposes. Because greater numbers of polymorphisms occur in the noncoding regions, fewer sequences are necessary to differentiate individuals. The noncoding sequences can comfortably provide positive individual identification with a panel of perhaps 10 to 1,000 primers that each yield a noncoding amplified sequence of 100 bases. If predicted coding sequences, such as those in SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 64, 66, 68, 70, 72, 74, 76, 78, 80, 82, 84, 86, 88, 90, 92, 94, 96, 98, 100, 102, 104, 106, 108, 110, 112, 114, 116, 118, 120, and 122 are used, a more appropriate number of primers for positive individual identification would be 500–2,000.

Predictive Medicine

The invention also pertains to the field of predictive medicine in which diagnostic assays, prognostic assays, pharmacogenomics, and monitoring clinical trials are used for prognostic (predictive) purposes to thereby treat an individual prophylactically. Accordingly, one aspect of the invention relates to diagnostic assays for determining NOVX protein and/or nucleic acid expression as well as NOVX activity, in the context of a biological sample (e.g., blood, serum, cells, tissue) to thereby determine whether an individual is afflicted with a disease or disorder, or is at risk of developing a disorder, associated with aberrant NOVX expression or activity. The disorders include metabolic disorders, diabetes, obesity, infectious disease, anorexia, cancer-associated cachexia, cancer, neurodegenerative disorders, Alzheimer's Disease, Parkinson's Disorder, immune disorders, and hematopoietic disorders, and the various dyslipidemias, metabolic disturbances associated with obesity, the metabolic syndrome X and wasting disorders associated with chronic diseases and various cancers. The invention also provides for prognostic (or predictive) assays for determining whether an individual is at risk of developing a disorder associated with NOVX protein, nucleic acid expression or activity. For example, mutations in an NOVX gene can be assayed in a biological sample. Such assays can be used for prognostic or predictive purpose to thereby prophylactically treat an individual prior to the onset of a disorder characterized by or associated with NOVX protein, nucleic acid expression, or biological activity.

Another aspect of the invention provides methods for determining NOVX protein, nucleic acid expression or activity in an individual to thereby select appropriate therapeutic or prophylactic agents for that individual (referred to herein as "pharmacogenomics"). Pharmacogenomics allows for the selection of agents (e.g., drugs) for therapeutic or prophylactic treatment of an individual based on the genotype of the individual (e.g., the genotype of the individual examined to determine the ability of the individual to respond to a particular agent.)

Yet another aspect of the invention pertains to monitoring the influence of agents (e.g., drugs, compounds) on the expression or activity of NOVX in clinical trials.

These and other agents are described in further detail in the following sections.

Diagnostic Assays

An exemplary method for detecting the presence or absence of NOVX in a biological sample involves obtaining a biological sample from a test subject and contacting the biological sample with a compound or an agent capable of detecting NOVX protein or nucleic acid (e.g., mRNA, genomic DNA) that encodes NOVX protein such that the presence of NOVX is detected in the biological sample. An agent for detecting NOVX mRNA or genomic DNA is a labeled nucleic acid probe capable of hybridizing to NOVX mRNA or genomic DNA. The nucleic acid probe can be, for example, a full-length NOVX nucleic acid, such as the nucleic acid of SEQ ID NOS:1, 3, 5, 7, 9, 11, 13, 15, 17, 19, 21, 23, 25, 27, 29, 31, 33, 35, and 37, or a portion thereof, such as an oligonucleotide of at least 15, 30, 50, 100, 250 or 500 nucleotides in length and sufficient to specifically hybridize under stringent conditions to NOVX mRNA or genomic DNA. Other suitable probes for use in the diagnostic assays of the invention are described herein.

An agent for detecting NOVX protein is an antibody capable of binding to NOVX protein, preferably an antibody with a detectable label. Antibodies can be polyclonal, or more preferably, monoclonal. An intact antibody, or a fragment thereof (e.g., Fab or F(ab')$_2$) can be used. The term "labeled", with regard to the probe or antibody, is intended to encompass direct labeling of the probe or antibody by coupling (i.e., physically linking) a detectable substance to the probe or antibody, as well as indirect labeling of the probe or antibody by reactivity with another reagent that is directly labeled. Examples of indirect labeling include detection of a primary antibody using a fluorescently-labeled secondary antibody and end-labeling of a DNA probe with biotin such that it can be detected with fluorescently-labeled streptavidin. The term "biological sample" is intended to include tissues, cells and biological fluids isolated from a subject, as well as tissues, cells and fluids present within a subject. That is, the detection method of the invention can be used to detect NOVX mRNA, protein, or genomic DNA in a biological sample in vitro as well as in vivo. For example, in vitro techniques for detection of NOVX mRNA include Northern hybridizations and in situ hybridizations. In vitro techniques for detection of NOVX protein include enzyme linked immunosorbent assays (ELISAs), Western blots, immunoprecipitations, and immunofluorescence. In vitro techniques for detection of NOVX genomic DNA include Southern hybridizations. Furthermore, in vivo techniques for detection of NOVX protein include introducing into a subject a labeled anti-NOVX antibody. For example, the antibody can be labeled with a radioactive marker whose presence and location in a subject can be detected by standard imaging techniques.

In one embodiment, the biological sample contains protein molecules from the test subject. Alternatively, the biological sample can contain mRNA molecules from the test subject or genomic DNA molecules from the test subject. A preferred biological sample is a peripheral blood leukocyte sample isolated by conventional means from a subject.

In another embodiment, the methods further involve obtaining a control biological sample from a control subject, contacting the control sample with a compound or agent capable of detecting NOVX protein, mRNA, or genomic DNA, such that the presence of NOVX protein, mRNA or genomic DNA is detected in the biological sample, and comparing the presence of NOVX protein, mRNA or genomic DNA in the control sample with the presence of NOVX protein, mRNA or genomic DNA in the test sample.

The invention also encompasses kits for detecting the presence of NOVX in a biological sample. For example, the kit can comprise: a labeled compound or agent capable of detecting NOVX protein or mRNA in a biological sample; means for determining the amount of NOVX in the sample; and means for comparing the amount of NOVX in the sample with a standard. The compound or agent can be packaged in a suitable container. The kit can further comprise instructions for using the kit to detect NOVX protein or nucleic acid.

Prognostic Assays

The diagnostic methods described herein can furthermore be utilized to identify subjects having or at risk of developing a disease or disorder associated with aberrant NOVX expression or activity. For example, the assays described herein, such as the preceding diagnostic assays or the following assays, can be utilized to identify a subject having or at risk of developing a disorder associated with NOVX protein, nucleic acid expression or activity. Alternatively, the prognostic assays can be utilized to identify a subject having or at risk for developing a disease or disorder. Thus, the invention provides a method for identifying a disease or disorder associated with aberrant NOVX expression or activity in which a test sample is obtained from a subject and NOVX protein or nucleic acid (e.g., mRNA, genomic DNA) is detected, wherein the presence of NOVX protein or nucleic acid is diagnostic for a subject having or at risk of developing a disease or disorder associated with aberrant NOVX expression or activity. As used herein, a "test sample" refers to a biological sample obtained from a subject of interest. For example, a test sample can be a biological fluid (e.g., serum), cell sample, or tissue.

Furthermore, the prognostic assays described herein can be used to determine whether a subject can be administered an agent (e.g., an agonist, antagonist, peptidomimetic, protein, peptide, nucleic acid, small molecule, or other drug candidate) to treat a disease or disorder associated with aberrant NOVX expression or activity. For example, such methods can be used to determine whether a subject can be effectively treated with an agent for a disorder. Thus, the invention provides methods for determining whether a subject can be effectively treated with an agent for a disorder associated with aberrant NOVX expression or activity in which a test sample is obtained and NOVX protein or nucleic acid is detected (e.g., wherein the presence of NOVX protein or nucleic acid is diagnostic for a subject that can be administered the agent to treat a disorder associated with aberrant NOVX expression or activity).

The methods of the invention can also be used to detect genetic lesions in an NOVX gene, thereby determining if a subject with the lesioned gene is at risk for a disorder characterized by aberrant cell proliferation and/or differentiation. In various embodiments, the methods include detecting, in a sample of cells from the subject, the presence or absence of a genetic lesion characterized by at least one of an alteration affecting the integrity of a gene encoding an NOVX-protein, or the misexpression of the NOVX gene. For example, such genetic lesions can be detected by ascertaining the existence of at least one of: (i) a deletion of one or more nucleotides from an NOVX gene; (ii) an addition of one or more nucleotides to an NOVX gene; (iii) a substitution of one or more nucleotides of an NOVX gene, (iv) a chromosomal rearrangement of an NOVX gene; (v) an alteration in the level of a messenger RNA transcript of an NOVX gene, (vi) aberrant modification of an NOVX gene, such as of the methylation pattern of the genomic DNA, (vii) the presence of a non-wild-type splicing pattern of a messenger RNA transcript of an NOVX gene, (viii) a non-wild-type level of an NOVX protein, (ix) allelic loss of an NOVX gene, and (x) inappropriate post-translational modification of an NOVX protein. As described herein, there are a large number of assay techniques known in the art which can be used for detecting lesions in an NOVX gene. A preferred biological sample is a peripheral blood leukocyte sample isolated by conventional means from a subject. However, any biological sample containing nucleated cells may be used, including, for example, buccal mucosal cells.

In certain embodiments, detection of the lesion involves the use of a probe/primer in a polymerase chain reaction (PCR) (see, e.g., U.S. Pat. Nos. 4,683,195 and 4,683,202), such as anchor PCR or RACE PCR, or, alternatively, in a ligation chain reaction (LCR) (see, e.g., Landegran, et al., 1988. *Science* 241: 1077–1080; and Nakazawa, et al., 1994. *Proc. Natl. Acad. Sci. USA* 91: 360–364), the latter of which can be particularly useful for detecting point mutations in the NOVX-gene (see, Abravaya, et al., 1995. *Nucl. Acids Res.* 23: 675–682). This method can include the steps of collecting a sample of cells from a patient, isolating nucleic acid (e.g., genomic, mRNA or both) from the cells of the sample, contacting the nucleic acid sample with one or more primers that specifically hybridize to an NOVX gene under conditions such that hybridization and amplification of the NOVX gene (if present) occurs, and detecting the presence or absence of an amplification product, or detecting the size of the amplification product and comparing the length to a control sample. It is anticipated that PCR and/or LCR may be desirable to use as a preliminary amplification step in conjunction with any of the techniques used for detecting mutations described herein.

Alternative amplification methods include: self sustained sequence replication (see, Guatelli, et al., 1990. *Proc. Natl. Acad. Sci. USA* 87: 1874–1878), transcriptional amplification system (see, Kwoh, et al., 1989. *Proc. Natl. Acad. Sci. USA* 86: 1173–1177); Qβ Replicase (see, Lizardi, et al, 1988. *BioTechnology* 6: 1197), or any other nucleic acid amplification method, followed by the detection of the amplified molecules using techniques well known to those of skill in the art. These detection schemes are especially useful for the detection of nucleic acid molecules if such molecules are present in very low numbers.

In an alternative embodiment, mutations in an NOVX gene from a sample cell can be identified by alterations in restriction enzyme cleavage patterns. For example, sample and control DNA is isolated, amplified (optionally), digested with one or more restriction endonucleases, and fragment length sizes are determined by gel electrophoresis and compared. Differences in fragment length sizes between sample and control DNA indicates mutations in the sample DNA. Moreover, the use of sequence specific ribozymes (see, e.g. U.S. Pat. No. 5,493,531) can be used to score for the presence of specific mutations by development or loss of a ribozyme cleavage site.

In other embodiments, genetic mutations in NOVX can be identified by hybridizing a sample and control nucleic acids, e.g., DNA or RNA, to high-density arrays containing hundreds or thousands of oligonucleotides probes. See, e.g., Cronin, et al., 1996. *Human Mutation* 7: 244–255; Kozal, et al., 1996. *Nat. Med.* 2: 753–759. For example, genetic mutations in NOVX can be identified in two dimensional arrays containing light-generated DNA probes as described in Cronin, et al., supra. Briefly, a first hybridization array of probes can be used to scan through long stretches of DNA in a sample and control to identify base changes between the sequences by making linear arrays of sequential overlapping probes. This step allows the identification of point mutations. This is followed by a second hybridization array that allows the characterization of specific mutations by using smaller, specialized probe arrays complementary to all variants or mutations detected. Each mutation array is composed of parallel probe sets, one complementary to the wild-type gene and the other complementary to the mutant gene.

In yet another embodiment, any of a variety of sequencing reactions known in the art can be used to directly sequence the NOVX gene and detect mutations by comparing the sequence of the sample NOVX with the corresponding wild-type (control) sequence. Examples of sequencing reactions include those based on techniques developed by Maxim and Gilbert, 1977. *Proc. Natl. Acad. Sci. USA* 74: 560 or Sanger, 1977. *Proc. Natl. Acad. Sci. USA* 74: 5463. It is also contemplated that any of a variety of automated sequencing procedures can be utilized when performing the diagnostic assays (see, e.g., Naeve, et al., 1995. *Biotechniques* 19: 448), including sequencing by mass spectrometry (see, e.g., PCT International Publication No. WO 94/16101; Cohen, et al., 1996. *Adv. Chromatography* 36: 127–162; and Griffin, et al., 1993. *Appl. Biochem. Biotechnol.* 38: 147–159).

Other methods for detecting mutations in the NOVX gene include methods in which protection from cleavage agents is used to detect mismatched bases in RNA/RNA or RNA/DNA heteroduplexes. See, e.g., Myers, et al., 1985. Science 230: 1242. In general, the art technique of "mismatch cleavage" starts by providing heteroduplexes of formed by hybridizing (labeled) RNA or DNA containing the wild-type NOVX sequence with potentially mutant RNA or DNA obtained from a tissue sample. The double-stranded duplexes are treated with an agent that cleaves single-stranded regions of the duplex such as which will exist due to basepair mismatches between the control and sample strands. For instance, RNA/DNA duplexes can be treated with RNase and DNA/DNA hybrids treated with $S_1$ nuclease to enzymatically digesting the mismatched regions. In other embodiments, either DNA/DNA or RNA/DNA duplexes can be treated with hydroxylamine or osmium tetroxide and with piperidine in order to digest mismatched regions. After digestion of the mismatched regions, the resulting material is then separated by size on denaturing polyacrylamide gels to determine the site of mutation. See, e.g., Cotton, et al., 1988. *Proc. Natl. Acad. Sci. USA* 85: 4397; Saleeba, et al., 1992. *Methods Enzymol.* 217: 286–295. In an embodiment, the control DNA or RNA can be labeled for detection.

In still another embodiment, the mismatch cleavage reaction employs one or more proteins that recognize mismatched base pairs in double-stranded DNA (so called "DNA mismatch repair" enzymes) in defined systems for detecting and mapping point mutations in NOVX cDNAs obtained from samples of cells. For example, the mutY enzyme of *E. coli* cleaves A at G/A mismatches and the thymidine DNA glycosylase from HeLa cells cleaves T at G/T mismatches. See, e.g., Hsu, et al., 1994. *Carcinogenesis* 15: 1657–1662. According to an exemplary embodiment, a probe based on an NOVX sequence, e.g., a wild-type NOVX sequence, is hybridized to a cDNA or other DNA product from a test cell(s). The duplex is treated with a DNA mismatch repair enzyme, and the cleavage products, if any, can be detected from electrophoresis protocols or the like. See, e.g., U.S. Pat. No. 5,459,039.

In other embodiments, alterations in electrophoretic mobility will be used to identify mutations in NOVX genes. For example, single strand conformation polymorphism (SSCP) may be used to detect differences in electrophoretic mobility between mutant and wild type nucleic acids. See, e.g., Orita, et al., 1989. *Proc. Natl. Acad. Sci. USA:* 86: 2766; Cotton, 1993. *Mutat. Res.* 285: 125–144; Hayashi, 1992. *Genet. Anal Tech. Appl.* 9: 73–79. Single-stranded DNA fragments of sample and control NOVX nucleic acids will be denatured and allowed to renature. The secondary structure of single-stranded nucleic acids varies according to sequence, the resulting alteration in electrophoretic mobility enables the detection of even a single base change. The DNA fragments may be labeled or detected with labeled probes. The sensitivity of the assay may be enhanced by using RNA (rather than DNA), in which the secondary structure is more sensitive to a change in sequence. In one embodiment, the subject method utilizes heteroduplex analysis to separate double stranded heteroduplex molecules on the basis of changes in electrophoretic mobility. See, e.g., Keen, et al., 1991. *Trends Genet.* 7: 5.

In yet another embodiment, the movement of mutant or wild-type fragments in polyacrylamide gels containing a gradient of denaturant is assayed using denaturing gradient gel electrophoresis (DGGE). See, e.g., Myers, et al., 1985. *Nature* 313: 495. When DGGE is used as the method of analysis, DNA will be modified to insure that it does not completely denature, for example by adding a GC clamp of approximately 40 bp of high-melting GC-rich DNA by PCR. In a further embodiment, a temperature gradient is used in place of a denaturing gradient to identify differences in the mobility of control and sample DNA. See, e.g. Rosenbaum and Reissner, 1987. Biophys. Chem. 265: 12753.

Examples of other techniques for detecting point mutations include, but are not limited to, selective oligonucleotide hybridization, selective amplification, or selective primer extension. For example, oligonucleotide primers may be prepared in which the known mutation is placed centrally and then hybridized to target DNA under conditions that permit hybridization only if a perfect match is found. See, e.g., Saiki, et al., 1986. *Nature* 324: 163; Saiki, et al., 1989. *Proc. Natl. Acad. Sci. USA* 86: 6230. Such allele specific oligonucleotides are hybridized to PCR amplified target DNA or a number of different mutations when the oligonucleotides are attached to the hybridizing membrane and hybridized with labeled target DNA.

Alternatively, allele specific amplification technology that depends on selective PCR amplification may be used in conjunction with the instant invention. Oligonucleotides used as primers for specific amplification may carry the mutation of interest in the center of the molecule (so that amplification depends on differential hybridization; see, e.g., Gibbs, et al., 1989. *Nucl. Acids Res.* 17: 2437–2448) or at the extreme 3'-terminus of one primer where, under appropriate conditions, mismatch can prevent, or reduce polymerase extension (see, e.g., Prossner, 1993. *Tibtech.* 11: 238). In addition it may be desirable to introduce a novel restriction site in the region of the mutation to create cleavage-based detection. See, e.g., Gasparini, et al., 1992. *Mol. Cell Probes* 6: 1. It is anticipated that in certain embodiments amplification may also be performed using Taq ligase for amplification. See, e.g., Barany, 1991. *Proc. Natl. Acad. Sci. USA* 88: 189. In such cases, ligation will occur only if there is a perfect match at the 3'-terminus of the 5' sequence, making it possible to detect the presence of a known mutation at a specific site by looking for the presence or absence of amplification.

The methods described herein may be performed, for example, by utilizing pre-packaged diagnostic kits comprising at least one probe nucleic acid or antibody reagent described herein, which may be conveniently used, e.g., in clinical settings to diagnose patients exhibiting symptoms or family history of a disease or illness involving an NOVX gene.

Furthermore, any cell type or tissue, preferably peripheral blood leukocytes, in which NOVX is expressed may be utilized in the prognostic assays described herein. However, any biological sample containing nucleated cells may be used, including, for example, buccal mucosal cells.

Pharmacogenomics

Agents, or modulators that have a stimulatory or inhibitory effect on NOVX activity (e.g., NOVX gene expression), as identified by a screening assay described herein can be administered to individuals to treat (prophylactically or therapeutically) disorders (The disorders include metabolic disorders, diabetes, obesity, infectious disease, anorexia, cancer-associated cachexia, cancer, neurodegenerative disorders, Alzheimer's Disease, Parkinson's Disorder, immune disorders, and hematopoictic disorders, and the various dyslipidemias, metabolic disturbances associated with obesity, the metabolic syndrome X and wasting disorders associated with chronic diseases and various cancers.) In conjunction with such treatment, the pharmacogenomics (i.e., the study of the relationship between an individual's genotype and that individual's response to a foreign compound or drug) of the individual may be considered. Differences in metabolism of therapeutics can lead to severe toxicity or therapeutic failure by altering the relation between dose and blood concentration of the pharmacologically active drug. Thus, the pharmacogenomics of the individual permits the selection of effective agents (e.g., drugs) for prophylactic or therapeutic treatments based on a consideration of the individual's genotype. Such pharmacogenomics can further be used to determine appropriate dosages and therapeutic regimens. Accordingly, the activity of NOVX protein, expression of NOVX nucleic acid, or mutation content of NOVX genes in an individual can be determined to thereby select appropriate agent(s) for therapeutic or prophylactic treatment of the individual.

Pharmacogenomics deals with clinically significant hereditary variations in the response to drugs due to altered drug disposition and abnormal action in affected persons. See e.g., Eichelbaum, 1996. *Clin. Exp. Pharmacol. Physiol.*, 23: 983–985; Linder, 1997. *Clin. Chem.*, 43: 254–266. In general, two types of pharmacogenetic conditions can be differentiated. Genetic conditions transmitted as a single factor altering the way drugs act on the body (altered drug action) or genetic conditions transmitted as single factors altering the way the body acts on drugs (altered drug metabolism). These pharmacogenetic conditions can occur either as rare defects or as polymorphisms. For example, glucose-6-phosphate dehydrogenase (G6PD) deficiency is a common inherited enzymopathy in which the main clinical complication is hemolysis after ingestion of oxidant drugs (anti-malarials, sulfonamides, analgesics, nitrofurans) and consumption of fava beans.

As an illustrative embodiment, the activity of drug metabolizing enzymes is a major determinant of both the intensity and duration of drug action. The discovery of genetic polymorphisms of drug metabolizing enzymes (e.g., N-acetyltransferase 2 (NAT 2) and cytochrome P450 enzymes CYP2D6 and CYP2C19) has provided an explanation as to why some patients do not obtain the expected drug effects or show exaggerated drug response and serious toxicity after taking the standard and safe dose of a drug. These polymorphisms are expressed in two phenotypes in the population, the extensive metabolizer (EM) and poor metabolizer (PM). The prevalence of PM is different among different populations. For example, the gene coding for CYP2D6 is highly polymorphic and several mutations have been identified in PM, which all lead to the absence of functional CYP2D6. Poor metabolizers of CYP2D6 and CYP2C19 quite frequently experience exaggerated drug response and side effects when they receive standard doses. If a metabolite is the active therapeutic moiety, PM show no therapeutic response, as demonstrated for the analgesic effect of codeine mediated by its CYP2D6-formed metabolite morphine. At the other extreme are the so called ultra-rapid metabolizers who do not respond to standard doses. Recently, the molecular basis of ultra-rapid metabolism has been identified to be due to CYP2D6 gene amplification.

Thus, the activity of NOVX protein, expression of NOVX nucleic acid, or mutation content of NOVX genes in an individual can be determined to thereby select appropriate agent(s) for therapeutic or prophylactic treatment of the individual. In addition, pharmacogenetic studies can be used to apply genotyping of polymorphic alleles encoding drug-metabolizing enzymes to the identification of an individual's drug responsiveness phenotype. This knowledge, when applied to dosing or drug selection, can avoid adverse reactions or therapeutic failure and thus enhance therapeutic or prophylactic efficiency when treating a subject with an NOVX modulator, such as a modulator identified by one of the exemplary screening assays described herein.

Monitoring of Effects During Clinical Trials

Monitoring the influence of agents (e.g., drugs, compounds) on the expression or activity of NOVX (e.g., the ability to modulate aberrant cell proliferation and/or differentiation) can be applied not only in basic drug screening, but also in clinical trials. For example, the effectiveness of an agent determined by a screening assay as described herein to increase NOVX gene expression, protein levels, or upregulate NOVX activity, can be monitored in clinical trails of subjects exhibiting decreased NOVX gene expression, protein levels, or down-regulated NOVX activity. Alternatively, the effectiveness of an agent determined by a screening assay to decrease NOVX gene expression, protein levels, or downregulate NOVX activity, can be monitored in clinical trails of subjects exhibiting increased NOVX gene expression, protein levels, or upregulated NOVX activity. In such clinical trials, the expression or activity of NOVX and, preferably, other genes that have been implicated in, for example, a cellular proliferation or immune disorder can be used as a "read out" or markers of the immune responsiveness of a particular cell.

By way of example, and not of limitation, genes, including NOVX, that are modulated in cells by treatment with an agent (e.g., compound, drug or small molecule) that modulates NOVX activity (e.g., identified in a screening assay as described herein) can be identified. Thus, to study the effect of agents on cellular proliferation disorders, for example, in a clinical trial, cells can be isolated and RNA prepared and analyzed for the levels of expression of NOVX and other genes implicated in the disorder. The levels of gene expression (i.e., a gene expression pattern) can be quantified by Northern blot analysis or RT-PCR, as described herein, or alternatively by measuring the amount of protein produced, by one of the methods as described herein, or by measuring the levels of activity of NOVX or other genes. In this manner, the gene expression pattern can serve as a marker, indicative of the physiological response of the cells to the agent. Accordingly, this response state may be determined before, and at various points during, treatment of the individual with the agent.

In one embodiment, the invention provides a method for monitoring the effectiveness of treatment of a subject with an agent (e.g., an agonist, antagonist, protein, peptide, peptidomimetic, nucleic acid, small molecule, or other drug candidate identified by the screening assays described herein) comprising the steps of (i) obtaining a pre-administration sample from a subject prior to administration of the agent; (ii) detecting the level of expression of an NOVX protein, mRNA, or genomic DNA in the preadministration sample; (iii) obtaining one or more post-administration samples from the subject; (iv) detecting the level of expression or activity of the NOVX protein, mRNA, or genomic DNA in the post-administration samples; (v) comparing the level of expression or activity of the NOVX protein, mRNA, or genomic DNA in the pre-administration sample with the NOVX protein, mRNA, or genomic DNA in the post administration sample or samples; and (vi) altering the administration of the agent to the subject accordingly. For example, increased administration of the agent may be desirable to increase the expression or activity of NOVX to higher levels than detected, i.e., to increase the effectiveness of the agent. Alternatively, decreased administration of the agent may be desirable to decrease expression or activity of NOVX to lower levels than detected, i.e., to decrease the effectiveness of the agent.

Methods of Treatment

The invention provides for both prophylactic and therapeutic methods of treating a subject at risk of (or susceptible to) a disorder or having a disorder associated with aberrant NOVX expression or activity. The disorders include cardiomyopathy, atherosclerosis, hypertension, congenital heart defects, aortic stenosis, atrial septal defect (ASD), atrioventricular (A-V) canal defect, ductus arteriosus, pulmonary stenosis, subaortic stenosis, ventricular septal defect (VSD), valve diseases, tuberous sclerosis, scleroderma, obesity, transplantation, adrenoleukodystrophy, congenital adrenal hyperplasia, prostate cancer, neoplasm; adenocarcinoma, lymphoma, uterus cancer, fertility, hemophilia, hypercoagulation, idiopathic thrombocytopenic purpura, immunodeficiencies, graft versus host disease, AIDS, bronchial asthma, Crohn's disease; multiple sclerosis, treatment of Albright Hereditary Ostoeodystrophy, and other diseases, disorders and conditions of the like.

These methods of treatment will be discussed more fully, below.

Disease and Disorders

Diseases and disorders that are characterized by increased (relative to a subject not suffering from the disease or disorder) levels or biological activity may be treated with Therapeutics that antagonize (i.e., reduce or inhibit) activity. Therapeutics that antagonize activity may be administered in a therapeutic or prophylactic manner. Therapeutics that may be utilized include, but are not limited to: (i) an aforementioned peptide, or analogs, derivatives, fragments or homologs thereof; (ii) antibodies to an aforementioned peptide; (iii) nucleic acids encoding an aforementioned peptide; (iv) administration of antisense nucleic acid and nucleic acids that are "dysfunctional" (i.e., due to a heterologous insertion within the coding sequences of coding sequences to an aforementioned peptide) that are utilized to "knockout" endogenous function of an aforementioned peptide by homologous recombination (see, e.g. Capecchi, 1989. *Science* 244: 1288–1292); or (v) modulators (i.e., inhibitors, agonists and antagonists, including additional peptide mimetic of the invention or antibodies specific to a peptide of the invention) that alter the interaction between an aforementioned peptide and its binding partner.

Diseases and disorders that are characterized by decreased (relative to a subject not suffering from the disease or disorder) levels or biological activity may be treated with Therapeutics that increase (i.e., are agonists to) activity. Therapeutics that upregulate activity may be administered in a therapeutic or prophylactic manner. Therapeutics that may be utilized include, but are not limited to, an aforementioned peptide, or analogs, derivatives, fragments or homologs thereof; or an agonist that increases bioavailability.

Increased or decreased levels can be readily detected by quantifying peptide and/or RNA, by obtaining a patient tissue sample (e.g., from biopsy tissue) and assaying it in vitro for RNA or peptide levels, structure and/or activity of the expressed peptides (or mRNAs of an aforementioned peptide). Methods that are well-known within the art include, but are not limited to, immunoassays (e.g., by Western blot analysis, immunoprecipitation followed by sodium dodecyl sulfate (SDS) polyacrylamide gel electrophoresis, immunocytochemistry, etc.) and/or hybridization assays to detect expression of mRNAs (e.g., Northern assays, dot blots, in situ hybridization, and the like).

Prophylactic Methods

In one aspect, the invention provides a method for preventing, in a subject, a disease or condition associated with an aberrant NOVX expression or activity, by administering to the subject an agent that modulates NOVX expression or at least one NOVX activity. Subjects at risk for a disease that is caused or contributed to by aberrant NOVX expression or activity can be identified by, for example, any or a combination of diagnostic or prognostic assays as described herein. Administration of a prophylactic agent can occur prior to the manifestation of symptoms characteristic of the NOVX aberrancy, such that a disease or disorder is prevented or, alternatively, delayed in its progression. Depending upon the type of NOVX aberrancy, for example, an NOVX agonist or NOVX antagonist agent can be used for treating the subject. The appropriate agent can be determined based on screening assays described herein. The prophylactic methods of the invention are further discussed in the following subsections.

Therapeutic Methods

Another aspect of the invention pertains to methods of modulating NOVX expression or activity for therapeutic purposes. The modulatory method of the invention involves contacting a cell with an agent that modulates one or more of the activities of NOVX protein activity associated with the cell. An agent that modulates NOVX protein activity can be an agent as described herein, such as a nucleic acid or a protein, a naturally-occurring cognate ligand of an NOVX protein, a peptide, an NOVX peptidomimetic, or other small molecule. In one embodiment, the agent stimulates one or more NOVX protein activity. Examples of such stimulatory agents include active NOVX protein and a nucleic acid molecule encoding NOVX that has been introduced into the cell. In another embodiment, the agent inhibits one or more NOVX protein activity. Examples of such inhibitory agents include antisense NOVX nucleic acid molecules and anti-NOVX antibodies. These modulatory methods can be performed in vitro (e.g., by culturing the cell with the agent) or, alternatively, in vivo (e.g., by administering the agent to a subject). As such, the invention provides methods of treating an individual afflicted with a disease or disorder characterized by aberrant expression or activity of an NOVX protein or nucleic acid molecule. In one embodiment, the method involves administering an agent (e.g., an agent identified by a screening assay described herein), or combination of agents that modulates (e.g., up-regulates or down-regulates) NOVX expression or activity. In another embodiment, the method involves administering an NOVX protein or nucleic acid molecule as therapy to compensate for reduced or aberrant NOVX expression or activity.

Stimulation of NOVX activity is desirable in situations in which NOVX is abnormally downregulated and/or in which increased NOVX activity is likely to have a beneficial effect. One example of such a situation is where a subject has a disorder characterized by aberrant cell proliferation and/or differentiation (e.g., cancer or immune associated disorders). Another example of such a situation is where the subject has a gestational disease (e.g., preclampsia).

Determination of the Biological Effect of the Therapeutic

In various embodiments of the invention, suitable in vitro or in vivo assays are performed to determine the effect of a specific Therapeutic and whether its administration is indicated for treatment of the affected tissue.

In various specific embodiments, in vitro assays may be performed with representative cells of the type(s) involved in the patient's disorder, to determine if a given Therapeutic exerts the desired effect upon the cell type(s). Compounds for use in therapy may be tested in suitable animal model systems including, but not limited to rats, mice, chicken, cows, monkeys, rabbits, and the like, prior to testing in human subjects. Similarly, for in vivo testing, any of the animal model system known in the art may be used prior to administration to human subjects.

Prophylactic and Therapeutic Uses of the Compositions of the Invention

The NOVX nucleic acids and proteins of the invention are useful in potential prophylactic and therapeutic applications implicated in a variety of disorders including, but not limited to: metabolic disorders, diabetes, obesity, infectious disease, anorexia, cancer-associated cancer, neurodegenerative disorders, Alzheimer's Disease, Parkinson's Disorder, immune disorders, hematopoietic disorders, and the various dyslipidemias, metabolic disturbances associated with obesity, the metabolic syndrome X and wasting disorders associated with chronic diseases and various cancers.

As an example, a cDNA encoding the NOVX protein of the invention may be useful in gene therapy, and the protein may be useful when administered to a subject in need thereof. By way of non-limiting example, the compositions of the invention will have efficacy for treatment of patients suffering from: metabolic disorders, diabetes, obesity, infectious disease, anorexia, cancer-associated cachexia, cancer, neurodegenerative disorders, Alzheimer's Disease, Parkinson's Disorder, immune disorders, hematopoietic disorders, and the various dyslipidemias.

Both the novel nucleic acid encoding the NOVX protein, and the NOVX protein of the invention, or fragments thereof, may also be useful in diagnostic applications, wherein the presence or amount of the nucleic acid or the protein are to be assessed. A further use could be as an anti-bacterial molecule (i.e., some peptides have been found to possess anti-bacterial properties). These materials are further useful in the generation of antibodies, which immunospecifically-bind to the novel substances of the invention for use in therapeutic or diagnostic methods.

The invention will be further described in the following examples, which do not limit the scope of the invention described in the claims.

EXAMPLES

Example 1

Quantitative Expression Analysis of Clones in Various Cells and Tissues

The quantitative expression of various clones was assessed using microtiter plates containing RNA samples from a variety of normal and pathology-derived cells, cell lines and tissues using real time quantitative PCR (RTQ PCR). RTQ PCR was performed on an Applied Biosystems ABI PRISM® 7700 or an ABI PRISM® 7900 HT Sequence Detection System. Various collections of samples are assembled on the plates, and referred to as Panel 1 (containing normal tissues and cancer cell lines), Panel 2 (containing samples derived from tissues from normal and cancer sources), Panel 3 (containing cancer cell lines), Panel 4 (containing cells and cell lines from normal tissues and cells related to inflammatory conditions), Panel 5D/5I (containing human tissues and cell lines with an emphasis on metabolic diseases), AI_comprehensive_panel (containing normal tissue and samples from autoimmune diseases), Panel CNSD.01 (containing central nervous system samples from normal and diseased brains) and CNS_neurodegeneration_panel (containing samples from normal and Alzheimer's diseased brains).

RNA integrity from all samples is controlled for quality by visual assessment of agarose gel electropherograms using 28S and 18S ribosomal RNA staining intensity ratio as a guide (2:1 to 2.5:1 28s: 18s) and the absence of low molecular weight RNAs that would be indicative of degradation products. Samples are controlled against genomic DNA contamination by RTQ PCR reactions run in the absence of reverse transcriptase using probe and primer sets designed to amplify across the span of a single exon.

First, the RNA samples were normalized to reference nucleic acids such as constitutively expressed genes (for example, β-actin and GAPDH). Normalized RNA (5 ul) was converted to cDNA and analyzed by RTQ-PCR using One Step RT-PCR Master Mix Reagents (Applied Biosystems; Catalog No. 4309169) and gene-specific primers according to the manufacturer's instructions.

In other cases, non-normalized RNA samples were converted to single strand cDNA (sscDNA) using Superscript II (Invitrogen Corporation; Catalog No. 18064-147) and random hexamers according to the manufacturer's instructions. Reactions containing up to 10 μg of total RNA were performed in a volume of 20 μl and incubated for 60 minutes at 42° C. This reaction can be scaled up to 50 μg of total RNA in a final volume of 100 μl. sscDNA samples are then normalized to reference nucleic acids as described previously, using 1× TaqMan® Universal Master mix (Applied Biosystems; catalog No. 4324020), following the manufacturer's instructions.

Probes and primers were designed for each assay according to Applied Biosystems Primer Express Software package (version I for Apple Computer's Macintosh Power PC) or a similar algorithm using the target sequence as input. Default settings were used for reaction conditions and the following parameters were set before selecting primers: primer concentration=250 nM, primer melting temperature (Tm) range=58°–60° C., primer optimal Tm=59° C., maximum primer difference=2° C., probe does not have 5'G, probe Tm must be 10° C. greater than primer Tm, amplicon size 75 bp to 100 bp. The probes and primers selected (see below) were synthesized by Synthegen (Houston, Tex., USA). Probes were double purified by HPLC to remove uncoupled dye and evaluated by mass spectroscopy to verify coupling of reporter and quencher dyes to the 5' and 3' ends of the probe, respectively. Their final concentrations were: forward and reverse primers, 900 nM each, and probe, 200 nM.

PCR conditions: When working with RNA samples, normalized RNA from each tissue and each cell line was spotted in each well of either a 96 well or a 384-well PCR plate (Applied Biosystems). PCR cocktails included either a single gene specific probe and primers set, or two multiplexed probe and primers sets (a set specific for the target clone and another gene-specific set multiplexed with the target probe). PCR reactions were set up using TaqMan® One-Step RT-PCR Master Mix (Applied Biosystems, Catalog No. 4313803) following manufacturer's instructions. Reverse transcription was performed at 48° C. for 30 minutes followed by amplification/PCR cycles as follows: 95° C. 10 min, then 40 cycles of 95° C. for 15 seconds, 60° C. for 1 minute. Results were recorded as CT values (cycle at which a given sample crosses a threshold level of fluorescence) using a log scale, with the difference in RNA concentration between a given sample and the sample with the lowest CT value being represented as 2 to the power of delta CT. The percent relative expression is then obtained by taking the reciprocal of this RNA difference and multiplying by 100.

When working with sscDNA samples, normalized sscDNA was used as described previously for RNA samples. PCR reactions containing one or two sets of probe and primers were set up as described previously, using 1× TaqMan® Universal Master mix (Applied Biosystems; catalog No. 4324020), following the manufacturer's instructions. PCR amplification was performed as follows: 95° C. 10 min, then 40 cycles of 95° C. for 15 seconds, 60° C. for 1 minute. Results were analyzed and processed as described previously.

Panels 1, 1.1, 1.2, and 1.3D

The plates for Panels 1, 1.1, 1.2 and 1.3D include 2 control wells (genomic DNA control and chemistry control) and 94 wells containing cDNA from various samples. The samples in these panels are broken into 2 classes: samples derived from cultured cell lines and samples derived from primary normal tissues. The cell lines are derived from cancers of the following types: lung cancer, breast cancer, melanoma, colon cancer, prostate cancer, CNS cancer, squamous cell carcinoma, ovarian cancer, liver cancer, renal cancer, gastric cancer and pancreatic cancer. Cell lines used in these panels are widely available through the American Type Culture Collection (ATCC), a repository for cultured cell lines, and were cultured using the conditions recommended by the ATCC. The normal tissues found on these panels are comprised of samples derived from all major organ systems from single adult individuals or fetuses. These samples are derived from the following organs: adult skeletal muscle, fetal skeletal muscle, adult heart, fetal heart, adult kidney, fetal kidney, adult liver, fetal liver, adult lung, fetal lung, various regions of the brain, the spleen, bone marrow, lymph node, pancreas, salivary gland, pituitary gland, adrenal gland, spinal cord, thymus, stomach, small intestine, colon, bladder, trachea, breast, ovary, uterus, placenta, prostate, testis and adipose.

In the results for Panels 1, 1.1, 1.2 and 1.3D, the following abbreviations are used:
  ca.=carcinoma,
  *=established from metastasis,
  met=metastasis,
  s cell var=small cell variant,
  non-s=non-sm=non-small,
  squam=squamous,
  pl. eff=pl effusion=pleural effusion,
  glio=glioma,
  astro=astrocytoma, and
  neuro=neuroblastoma.

General_Screening_Panel_v1.4

The plates for Panel 1.4 include 2 control wells (genomic DNA control and chemistry control) and 94 wells containing cDNA from various samples. The samples in Panel 1.4 are broken into 2 classes: samples derived from cultured cell lines and samples derived from primary normal tissues. The cell lines are derived from cancers of the following types: lung cancer, breast cancer, melanoma, colon cancer, prostate cancer, CNS cancer, squamous cell carcinoma, ovarian cancer, liver cancer, renal cancer, gastric cancer and pancreatic cancer. Cell lines used in Panel 1.4 are widely available through the American Type Culture Collection (ATCC), a repository for cultured cell lines, and were cultured using the conditions recommended by the ATCC. The normal tissues found on Panel 1.4 are comprised of pools of samples derived from all major organ systems from 2 to 5 different adult individuals or fetuses. These samples are derived from the following organs: adult skeletal muscle, fetal skeletal muscle, adult heart, fetal heart, adult kidney, fetal kidney, adult liver, fetal liver, adult lung, fetal lung, various regions of the brain, the spleen, bone marrow, lymph node, pancreas, salivary gland, pituitary gland, adrenal gland, spinal cord, thymus, stomach, small intestine, colon, bladder, trachea, breast, ovary, uterus, placenta, prostate, testis and adipose. Abbreviations are as described for Panels 1, 1.1, 1.2, and 1.3D.

Panels 2D and 2.2

The plates for Panels 2D and 2.2 generally include 2 control wells and 94 test samples composed of RNA or cDNA isolated from human tissue procured by surgeons working in close cooperation with the National Cancer Institute's Cooperative Human Tissue Network (CHTN) or the National Disease Research Initiative (NDRI). The tissues are derived from human malignancies and in cases where indicated many malignant tissues have "matched margins" obtained from noncancerous tissue just adjacent to the tumor. These are termed normal adjacent tissues and are denoted "NAT" in the results below. The tumor tissue and the "matched margins" are evaluated by two independent pathologists (the surgical pathologists and again by a pathologist at NDRI or CHTN). This analysis provides a gross histopathological assessment of tumor differentiation grade. Moreover, most samples include the original surgical pathology report that provides information regarding the clinical stage of the patient. These matched margins are taken from the tissue surrounding (i.e. immediately proximal) to the zone of surgery (designated "NAT", for normal adjacent tissue, in Table RR). In addition, RNA and cDNA samples were obtained from various human tissues derived from autopsies performed on elderly people or sudden death victims (accidents, etc.). These tissues were ascertained to be free of disease and were purchased from various commercial sources such as Clontech (Palo Alto, Calif.), Research Genetics, and Invitrogen.

Panel 3D

The plates of Panel 3D are comprised of 94 cDNA samples and two control samples. Specifically, 92 of these samples are derived from cultured human cancer cell lines, 2 samples of human primary cerebellar tissue and 2 controls. The human cell lines are generally obtained from ATCC (American Type Culture Collection), NCI or the German tumor cell bank and fall into the following tissue groups: Squamous cell carcinoma of the tongue, breast cancer, prostate cancer, melanoma, epidermoid carcinoma, sarcomas, bladder carcinomas, pancreatic cancers, kidney cancers, leukemias/lymphomas, ovarian/uterine/cervical, gastric, colon, lung and CNS cancer cell lines. In addition, there are two independent samples of cerebellum. These cells are all cultured under standard recommended conditions and RNA extracted using the standard procedures. The cell lines in panel 3D and 1.3D are of the most common cell lines used in the scientific literature.

Panels 4D, 4R, and 4.1D

Panel 4 includes samples on a 96 well plate (2 control wells, 94 test samples) composed of RNA (Panel 4R) or cDNA (Panels 4D/4. ID) isolated from various human cell lines or tissues related to inflammatory conditions. Total RNA from control normal tissues such as colon and lung (Stratagene, La Jolla, Calif.) and thymus and kidney (Clontech) was employed. Total RNA from liver tissue from cirrhosis patients and kidney from lupus patients was obtained from BioChain (Biochain Institute, Inc., Hayward, Calif.). Intestinal tissue for RNA preparation from patients diagnosed as having Crohn's disease and ulcerative colitis was obtained from the National Disease Research Interchange (NDRI) (Philadelphia, Pa.).

Astrocytes, lung fibroblasts, dermal fibroblasts, coronary artery smooth muscle cells, small airway epithelium, bronchial epithelium, microvascular dermal endothelial cells, microvascular lung endothelial cells, human pulmonary aortic endothelial cells, human umbilical vein endothelial cells were all purchased from Clonetics (Walkersville, Md.) and grown in the media supplied for these cell types by Clonetics. These primary cell types were activated with various cytokines or combinations of cytokines for 6 and/or 12–14 hours, as indicated. The following cytokines were used; IL-1 beta at approximately 1–5 ng/ml, TNF alpha at approximately 5–10 ng/ml, IFN gamma at approximately 20–50 ng/ml, IL-4 at approximately 510 ng/ml, IL-9 at approximately 5–10 ng/ml, IL-13 at approximately 5–10 ng/ml. Endothelial cells were sometimes starved for various times by culture in the basal media from Clonetics with 0.1% serum.

Mononuclear cells were prepared from blood of employees at CuraGen Corporation, using Ficoll. LAK cells were prepared from these cells by culture in DMEM 5% FCS (Hyclone), 100 μM non essential amino acids (Gibco/Life Technologies, Rockville, Md.), 1 mM sodium pyruvate (Gibco), mercaptoethanol $5.5\times10^{-5}$ M (Gibco), and 10 mM Hepes (Gibco) and Interleukin 2 for 4–6 days. Cells were then either activated with 10–20 ng/ml PMA and 1–2 μg/ml ionomycin, IL-12 at 5–10 ng/ml, IFN gamma at 20–50 ng/ml and IL-18 at 5–10 ng/ml for 6 hours. In some cases, mononuclear cells were cultured for 4–5 days in DMEM 5% FCS (Hyclone), 100 μM non essential amino acids (Gibco), 1 mM sodium pyruvate (Gibco), mercaptoethanol $5.5\times10^{-5}$ M (Gibco), and 10 mM Hepes (Gibco) with PHA (phytohemagglutinin) or PWM (pokeweed mitogen) at approximately 5 g/ml. Samples were taken at 24, 48 and 72 hours for RNA preparation. MLR (mixed lymphocyte reaction) samples were obtained by taking blood from two donors, isolating the mononuclear cells using Ficoll and mixing the isolated mononuclear cells 1:1 at a final concentration of approximately $2\times10^6$ cells/ml in DMEM 5% FCS (Hyclone), 100 μM non essential amino acids (Gibco), 1 mM sodium pyruvate (Gibco), mercaptoethanol ($5.5\times10^{-5}$ M) (Gibco), and 10 mM Hepes (Gibco). The MLR was cultured and samples taken at various time points ranging from 1–7 days for RNA preparation.

Monocytes were isolated from mononuclear cells using CD14 Miltenyi Beads, +ve VS selection columns and a Vario Magnet according to the manufacturer's instructions. Monocytes were differentiated into dendritic cells by culture in DMEM 5% fetal calf serum (FCS) (Hyclone, Logan, Utah), 100 μM non essential amino acids (Gibco), 1 mM sodium pyruvate (Gibco), mercaptoethanol $5.5\times10^{-5}$ M (Gibco), and 10 mM Hepes (Gibco), 50 ng/ml GMCSF and 5 ng/ml IL-4 for 5–7 days. Macrophages were prepared by culture of monocytes for 5–7 days in DMEM 5% FCS (Hyclone), 100 μM non essential amino acids (Gibco), 1 mM sodium pyruvate (Gibco), mercaptoethanol $5.5\times10^{-5}$ M (Gibco), 10 mM Hepes (Gibco) and 10% AB Human Serum or MCSF at approximately 50 ng/ml. Monocytes, macrophages and dendritic cells were stimulated for 6 and 12–14 hours with lipopolysaccharide (LPS) at 100 ng/ml. Dendritic cells were also stimulated with anti-CD40 monoclonal antibody (Pharmingen) at 10 μg/ml for 6 and 12–14 hours.

CD4 lymphocytes, CD8 lymphocytes and NK cells were also isolated from mononuclear cells using CD4, CD8 and CD56 Miltenyi beads, positive VS selection columns and a Vario Magnet according to the manufacturer's instructions. CD45RA and CD45RO CD4 lymphocytes were isolated by depleting mononuclear cells of CD8, CD56, CD14 and CD19 cells using CD8, CD56, CD14 and CD19 Miltenyi beads and positive selection. CD45RO beads were then used to isolate the CD45RO CD4 lymphocytes with the remaining cells being CD45RA CD4 lymphocytes. CD45RA CD4, CD45RO CD4 and CD8 lymphocytes were placed in DMEM 5% FCS (Hyclone), 100 μM non essential amino acids (Gibco), 1 mM sodium pyruvate (Gibco), mercaptoethanol $5.5\times10^{-5}$ M (Gibco), and 10 mM Hepes (Gibco) and plated at $10^6$ cells/ml onto Falcon 6 well tissue culture plates that had been coated overnight with 0.5 µg/ml anti-CD28 (Pharmingen) and 3 ug/ml anti-CD3 (OKT3, ATCC) in PBS. After 6 and 24 hours, the cells were harvested for RNA preparation. To prepare chronically activated CD8 lymphocytes, we activated the isolated CD8 lymphocytes for 4 days on anti-CD28 and anti-CD3 coated plates and then harvested the cells and expanded them in DMEM 5% FCS (Hyclone), 100 µM non essential amino acids (Gibco), 1 mM sodium pyruvate (Gibco), mercaptoethanol $5.5\times10^{-5}$M (Gibco), and 10 mM Hepes (Gibco) and IL-2. The expanded CD8 cells were then activated again with plate bound anti-CD3 and anti-CD28 for 4 days and expanded as before. RNA was isolated 6 and 24 hours after the second activation and after 4 days of the second expansion culture. The isolated NK cells were cultured in DMEM 5% FCS (Hyclone), 100 µM non essential amino acids (Gibco), 1 mM sodium pyruvate (Gibco), mercaptoethanol $5.5\times10^{-5}$M (Gibco), and 10 mM Hepes (Gibco) and IL-2 for 4–6 days before RNA was prepared.

To obtain B cells, tonsils were procured from NDRI. The tonsil was cut up with sterile dissecting scissors and then passed through a sieve. Tonsil cells were then spun down and resupended at $10^6$ cells/ml in DMEM 5% FCS (Hyclone), 100 µM non essential amino acids (Gibco), 1 mM sodium pyruvate (Gibco), mercaptoethanol $5.5\times10^{-5}$M (Gibco), and 10 mM Hepes (Gibco). To activate the cells, we used PWM at 5 µg/ml or anti-CD40 (Pharmingen) at approximately 10 µg/ml and IL-4 at 5–10 ng/ml. Cells were harvested for RNA preparation at 24, 48 and 72 hours.

To prepare the primary and secondary Th1/Th2 and Tr1 cells, six-well Falcon plates were coated overnight with 10 µg/ml anti-CD28 (Pharmingen) and 2 µg/ml OKT3 (ATCC), and then washed twice with PBS. Umbilical cord blood CD4 lymphocytes (Poietic Systems, German Town, Md.) were cultured at $10^5$–$10^6$ cells/ml in DMEM 5% FCS (Hyclone), 100lM non essential amino acids (Gibco), 1 mM sodium pyruvate (Gibco), mercaptoethanol $5.5\times10^{-5}$M (Gibco), 10 mM Hepes (Gibco) and IL-2 (4 ng/ml). IL-12 (5 ng/ml) and anti-IL4 (1 µg/ml) were used to direct to Th1, while IL-4 (5 ng/ml) and anti-IFN gamma (1 µg/ml) were used to direct to Th2 and IL-10 at 5 ng/ml was used to direct to Tr1. After 4–5 days, the activated Th1, Th2 and Tr1 lymphocytes were washed once in DMEM and expanded for 4–7 days in DMEM 5% FCS (Hyclone), 100 µM non essential amino acids (Gibco), 1 mM sodium pyruvate (Gibco), mercaptoethanol $5.5\times10^{-5}$M (Gibco), 10 mM Hepes (Gibco) and IL-2 (1 ng/ml). Following this, the activated Th1, Th2 and Tr1 lymphocytes were re-stimulated for 5 days with anti-CD28/OKT3 and cytokines as described above, but with the addition of anti-CD95L (1 µg/ml) to prevent apoptosis. After 4–5 days, the Th1, Th2 and Tr1 lymphocytes were washed and then expanded again with IL-2 for 4–7 days. Activated Th1 and Th2 lymphocytes were maintained in this way for a maximum of three cycles. RNA was prepared from primary and secondary Th1, Th2 and Tr1 after 6 and 24 hours following the second and third activations with plate bound anti-CD3 and anti-CD28 mAbs and 4 days into the second and third expansion cultures in Interleukin 2.

The following leukocyte cells lines were obtained from the ATCC: Ramos, EOL-1, KU-812. EOL cells were further differentiated by culture in 0.1 mM dbcAMP at $5\times10^5$ cells/ml for 8 days, changing the media every 3 days and adjusting the cell concentration to $5\times10^5$ cells/ml. For the culture of these cells, we used DMEM or RPMI (as recommended by the ATCC), with the addition of 5% FCS (Hyclone), 100M non essential amino acids (Gibco), 1 mM sodium pyruvate (Gibco), mercaptoethanol $5.5\times10^{-5}$M (Gibco), 10 mM Hepes (Gibco). RNA was either prepared from resting cells or cells activated with PMA at 10 ng/ml and ionomycin at 1 µg/ml for 6 and 14 hours. Keratinocyte line CCD106 and an airway epithelial tumor line NCI-H292 were also obtained from the ATCC. Both were cultured in DMEM 5% FCS (Hyclone), 100 µM non essential amino acids (Gibco), 1 mM sodium pyruvate (Gibco), mercaptoethanol $5.5\times10^{-5}$M (Gibco), and 10 mM Hepes (Gibco). CCD1106 cells were activated for 6 and 14 hours with approximately 5 ng/ml TNF alpha and 1 ng/ml IL-1 beta, while NCI-H292 cells were activated for 6 and 14 hours with the following cytokines: 5 ng/ml IL-4, 5 ng/ml IL-9, 5 ng/ml IL-13 and 25 ng/ml IFN gamma.

For these cell lines and blood cells, RNA was prepared by lysing approximately $10^7$ cells/ml using Trizol (Gibco BRL). Briefly, 1/10 volume of bromochloropropane (Molecular Research Corporation) was added to the RNA sample, vortexed and after 10 minutes at room temperature, the tubes were spun at 14,000 rpm in a Sorvall SS34 rotor. The aqueous phase was removed and placed in a 15 ml Falcon Tube. An equal volume of isopropanol was added and left at −20° C. overnight. The precipitated RNA was spun down at 9,000 rpm for 15 min in a Sorvall SS34 rotor and washed in 70% ethanol. The pellet was redissolved in 30011 of RNAse-free water and 35 µl buffer (Promega) 5 µl DTT, 7 µl RNAsin and 8 µl DNAse were added. The tube was incubated at 37° C. for 30 minutes to remove contaminating genomic DNA, extracted once with phenol chloroform and re-precipitated with 1/10 volume of 3M sodium acetate and 2 volumes of 100% ethanol. The RNA was spun down and placed in RNAse free water. RNA was stored at −80° C.

AI_Comprehensive Panel_v1.0

The plates for AI_comprehensive panel_v1.0 include two control wells and 89 test samples comprised of cDNA isolated from surgical and postmortem human tissues obtained from the Backus Hospital and Clinomics (Frederick, Md.). Total RNA was extracted from tissue samples from the Backus Hospital in the Facility at CuraGen. Total RNA from other tissues was obtained from Clinomics.

Joint tissues including synovial fluid, synovium, bone and cartilage were obtained from patients undergoing total knee or hip replacement surgery at the Backus Hospital. Tissue samples were immediately snap frozen in liquid nitrogen to ensure that isolated RNA was of optimal quality and not degraded. Additional samples of osteoarthritis and rheumatoid arthritis joint tissues were obtained from Clinomics. Normal control tissues were supplied by Clinomics and were obtained during autopsy of trauma victims.

Surgical specimens of psoriatic tissues and adjacent matched tissues were provided as total RNA by Clinomics. Two male and two female patients were selected between the ages of 25 and 47. None of the patients were taking prescription drugs at the time samples were isolated.

Surgical specimens of diseased colon from patients with ulcerative colitis and Crohns disease and adjacent matched tissues were obtained from Clinomics. Bowel tissue from three female and three male Crohn's patients between the ages of 41–69 were used. Two patients were not on prescription medication while the others were taking dexamethasone, phenobarbital, or tylenol. Ulcerative colitis tissue was from three male and four female patients. Four of the patients were taking lebvid and two were on phenobarbital.

Total RNA from post mortem lung tissue from trauma victims with no disease or with emphysema, asthma or COPD was purchased from Clinomics. Emphysema patients ranged in age from 40–70 and all were smokers, this age range was chosen to focus on patients with cigarette-linked emphysema and to avoid those patients with alpha-1antitrypsin deficiencies. Asthma patients ranged in age from 36–75, and excluded smokers to prevent those patients that could also have COPD. COPD patients ranged in age from 35–80 and included both smokers and non-smokers. Most patients were taking corticosteroids, and bronchodilators.

In the labels employed to identify tissues in the AI_comprehensive panel_v1.0 panel, the following abbreviations are used:
AI=Autoimmunity
Syn=Synovial
Normal=No apparent disease
Rep22/Rep20=individual patients
RA=Rheumatoid arthritis
Backus=From Backus Hospital
OA=Osteoarthritis
(SS) (BA) (MF)=Individual patients
Adj=Adjacent tissue
Match control=adjacent tissues
-M=Male
-F=Female
COPD=Chronic obstructive pulmonary disease Panels 5D and 5I The plates for Panel 5D and 5I include two control wells and a variety of cDNAs isolated from human tissues and cell lines with an emphasis on metabolic diseases. Metabolic tissues were obtained from patients enrolled in the Gestational Diabetes study. Cells were obtained during different stages in the differentiation of adipocytes from human mesenchymal stem cells. Human pancreatic islets were also obtained.

In the Gestational Diabetes study subjects are young (18–40 years), otherwise healthy women with and without gestational diabetes undergoing routine (elective) Caesarean section. After delivery of the infant, when the surgical incisions were being repaired/closed, the obstetrician removed a small sample (<1 cc) of the exposed metabolic tissues during the closure of each surgical level. The biopsy material was rinsed in sterile saline, blotted and fast frozen within 5 minutes from the time of removal. The tissue was then flash frozen in liquid nitrogen and stored, individually, in sterile screw-top tubes and kept on dry ice for shipment to or to be picked up by CuraGen. The metabolic tissues of interest include uterine wall (smooth muscle), visceral adipose, skeletal muscle (rectus) and subcutaneous adipose. Patient descriptions are as follows:
Patient 2: Diabetic Hispanic, overweight, not on insulin
Patient 7–9: Nondiabetic Caucasian and obese (BMI>30)
Patient 10: Diabetic Hispanic, overweight, on insulin
Patient 11: Nondiabetic African American and overweight
Patient 12: Diabetic Hispanic on insulin Adipocyte differentiation was induced in donor progenitor cells obtained from Osirus (a division of Clonetics/BioWhittaker) in triplicate, except for Donor 3U which had only two replicates. Scientists at Clonetics isolated, grew and differentiated human mesenchymal stem cells (HuMSCs) for CuraGen based on the published protocol found in Mark F. Pittenger, et al., Multilineage Potential of Adult Human Mesenchymal Stem Cells Science Apr. 2, 1999: 143–147. Clonetics provided Trizol lysates or frozen pellets suitable for mRNA isolation and ds cDNA production. A general description of each donor is as follows:
Donor 2 and 3 U: Mesenchymal Stem cells, Undifferentiated Adipose
Donor 2 and 3 AM: Adipose, AdiposeMidway Differentiated
Donor 2 and 3 AD: Adipose, Adipose Differentiated Human cell lines were generally obtained from ATCC (American Type Culture Collection), NCI or the German tumor cell bank and fall into the following tissue groups: kidney proximal convoluted tubule, uterine smooth muscle cells, small intestine, liver HepG2 cancer cells, heart primary stromal cells, and adrenal cortical adenoma cells. These cells are all cultured under standard recommended conditions and RNA extracted using the standard procedures. All samples were processed at CuraGen to produce single stranded cDNA.

Panel 5I contains all samples previously described with the addition of pancreatic islets from a 58 year old female patient obtained from the Diabetes Research Institute at the University of Miami School of Medicine. Islet tissue was processed to total RNA at an outside source and delivered to CuraGen for addition to panel 5I.

In the labels employed to identify tissues in the 5D and 5I panels, the following abbreviations are used:
GO Adipose=Greater Omentum Adipose
SK=Skeletal Muscle
UT=Uterus
PL=Placenta
AD=Adipose Differentiated
AM=Adipose Midway Differentiated
U=Undifferentiated Stem Cells Panel CNSD0.1

The plates for Panel CNSD.01 include two control wells and 94 test samples comprised of cDNA isolated from postmortem human brain tissue obtained from the Harvard Brain Tissue Resource Center. Brains are removed from calvaria of donors between 4 and 24 hours after death, sectioned by neuroanatomists, and frozen at −80° C. in liquid nitrogen vapor. All brains are sectioned and examined by neuropathologists to confirm diagnoses with clear associated neuropathology.

Disease diagnoses are taken from patient records. The panel contains two brains from each of the following diagnoses: Alzheimer's disease, Parkinson's disease, Huntington's disease, Progressive Supemuclear Palsy, Depression, and "Normal controls". Within each of these brains, the following regions are represented: cingulate gyrus, temporal pole, globus palladus, substantia nigra, Brodman Area 4 (primary motor strip), Brodman Area 7 (parietal cortex), Brodman Area 9 (prefrontal cortex), and Brodman area 17 (occipital cortex). Not all brain regions are represented in all cases; e.g., Huntington's disease is characterized in part by neurodegeneration in the globus palladus, thus this region is impossible to obtain from confirmed Huntington's cases. Likewise Parkinson's disease is characterized by degeneration of the substantia nigra making this region more difficult to obtain. Normal control brains were examined for neuropathology and found to be free of any pathology consistent with neurodegeneration.

In the labels employed to identify tissues in the CNS panel, the following abbreviations are used:
PSP=Progressive supranuclear palsy
Sub Nigra=Substantia nigra
Glob Palladus=Globus palladus
Temp Pole=Temporal pole
Cing Gyr=Cingulate gyrus
BA 4=Brodman Area 4

Panel CNS_Neurodegeneration_V1.0

The plates for Panel CNS_Neurodegeneration_V1.0 include two control wells and 47 test samples comprised of cDNA isolated from postmortem human brain tissue obtained from the Harvard Brain Tissue Resource Center (McLean Hospital) and the Human Brain and Spinal Fluid Resource Center (VA Greater Los Angeles Healthcare System). Brains are removed from calvaria of donors between 4 and 24 hours after death, sectioned by neuroanatomists, and frozen at −80° C. in liquid nitrogen vapor. All brains are sectioned and examined by neuropathologists to confirm diagnoses with clear associated neuropathology.

Disease diagnoses are taken from patient records. The panel contains six brains from Alzheimer's disease (AD) patients, and eight brains from "Normal controls" who showed no evidence of dementia prior to death. The eight normal control brains are divided into two categories: Controls with no dementia and no Alzheimer's like pathology (Controls) and controls with no dementia but evidence of severe Alzheimer's like pathology, (specifically senile plaque load rated as level 3 on a scale of 0–3; 0=no evidence of plaques, 3=severe AD senile plaque load). Within each of these brains, the following regions are represented: hippocampus, temporal cortex (Brodman Area 21), parietal cortex (Brodman area 7), and occipital cortex (Brodman area 17). These regions were chosen to encompass all levels of neurodegeneration in AD. The hippocampus is a region of early and severe neuronal loss in AD; the temporal cortex is known to show neurodegeneration in AD after the hippocampus; the parietal cortex shows moderate neuronal death in the late stages of the disease; the occipital cortex is spared in AD and therefore acts as a "control" region within AD patients. Not all brain regions are represented in all cases.

In the labels employed to identify tissues in the CNS-_Neurodegeneration_V1.0 panel, the following abbreviations are used:
AD=Alzheimer's disease brain; patient was demented and showed AD-like pathology upon autopsy
Control=Control brains; patient not demented, showing no neuropathology
Control (Path)=Control brains; pateint not demented but showing sever AD-like pathology
SupTemporal Ctx=Superior Temporal Cortex
Inf Temporal Ctx=Inferior Temporal Cortex NOV1: CG56181-01: Neurotrophin—isoform 1

Expression of gene CG56181-01 was assessed using the primer-probe set Ag2943, described in Table AA.

TABLE AA

Probe Name Ag2943

| Primers | Sequences | Length | Start Position |
|---|---|---|---|
| Forward | 5'-gactgctgtggacttggttg-3' (SEQ ID NO: 341) | 20 | 465 |
| Probe | TET-5'-gaggtggaggtgttgggcgaggt-3'-TAMRA (SEQ ID NO:342) | 23 | 490 |
| Reverse | 5'-aaagaagtgttggtggaggg-3' (SEQ ID NO:343) | 20 | 533 |

CNS_neurodegeneration_v1.0 Summary: Ag2943 Expression of the CG56181-01 gene is low/undetectable in all samples on this panel (CTs>35).

Panel 1.3D Summary: Ag2943 Expression of the CG56181-01 gene is low/undetectable in all samples on this panel (CTs>35).

Panel 4D Summary: Ag2943 Expression of the CG56181-01 gene is low/undetectable in all samples on this panel (CTs>35).

NOV2: CG56275-01: Guanylate Kinase

Expression of gene CG56275-01 was assessed using the primer-probe set Ag2944, described in Table BA. Results of the RTQ-PCR runs are shown in Tables BB, BC, BD and BE.

TABLE BA

Probe Name Ag2944

| Primers | Sequences | Length | Start Position |
|---|---|---|---|
| Forward | 5'-ccttaggaccctctggtgtt-3' (SEQ ID NO:344) | 20 | 745 |
| Probe | TET-5'-caacttattgaatttaatcccagcca-3'-TAMRA (SEQ ID NO:345) | 26 | 786 |
| Reverse | 5'-tagttggcacagcactttga-3' (SEQ ID NO:346) | 20 | 815 |

TABLE BB

Panel 1.3D

| Tissue Name | Rel. Exp. (%) Ag2944, Run 162293950 | Rel. Exp. (%) Ag2944, Run 165701957 |
|---|---|---|
| Liver adenocarcinoma | 6.7 | 1.9 |
| Pancreas | 0.0 | 0.0 |
| Pancreatic ca. CAPAN 2 | 0.0 | 0.0 |
| Adrenal gland | 0.0 | 0.0 |
| Thyroid | 0.5 | 0.0 |
| Salivary gland | 0.5 | 0.0 |
| Pituitary gland | 0.0 | 0.0 |
| Brain (fetal) | 1.8 | 0.7 |
| Brain (whole) | 1.7 | 6.1 |
| Brain (amygdala) | 1.2 | 4.2 |
| Brain (cerebellum) | 11.0 | 17.3 |
| Brain (hippocampus) | 3.4 | 7.2 |
| Brain (substantia nigra) | 1.6 | 2.9 |
| Brain (thalamus) | 0.0 | 11.6 |
| Cerebral Cortex | 8.8 | 1.8 |
| Spinal cord | 0.7 | 0.0 |
| glio/astro U87-MG | 100.0 | 35.1 |
| glio/astro U-118-MG | 36.9 | 100.0 |
| astrocytoma SW1783 | 43.5 | 12.4 |
| neuro*; met SK-N-AS | 0.7 | 1.1 |
| astrocytoma SF-539 | 0.8 | 2.3 |
| astrocytoma SNB-75 | 2.9 | 11.0 |
| glioma SNB-19 | 3.9 | 6.7 |
| glioma U251 | 0.3 | 2.4 |
| glioma SF-295 | 0.3 | 1.0 |
| Heart (fetal) | 0.7 | 0.0 |
| Heart | 0.0 | 1.1 |
| Skeletal muscle (fetal) | 4.6 | 1.4 |
| Skeletal muscle | 0.8 | 3.3 |
| Bone marrow | 0.0 | 0.0 |
| Thymus | 0.0 | 0.0 |
| Spleen | 3.9 | 4.8 |
| Lymph node | 1.2 | 0.0 |
| Colorectal | 2.3 | 0.9 |
| Stomach | 0.0 | 0.0 |
| Small intestine | 0.0 | 0.0 |
| Colon ca. SW480 | 0.9 | 1.4 |

TABLE BB-continued

Panel 1.3D

| Tissue Name | Rel. Exp. (%) Ag2944, Run 162293950 | Rel. Exp. (%) Ag2944, Run 165701957 |
|---|---|---|
| Colon ca.* SW620 (SW480 met) | 0.0 | 0.0 |
| Colon ca. HT29 | 0.0 | 0.0 |
| Colon ca. HCT-116 | 0.0 | 0.8 |
| Colon ca. CaCo-2 | 2.9 | 1.1 |
| Colon ca. tissue (ODO3866) | 0.8 | 0.0 |
| Colon ca. HCC-2998 | 0.0 | 0.0 |
| Gastric ca.* (liver met) NCI-N87 | 0.5 | 3.9 |
| Bladder | 1.9 | 0.0 |
| Trachea | 0.0 | 0.0 |
| Kidney | 0.9 | 0.0 |
| Kidney (fetal) | 0.0 | 4.4 |
| Renal ca. 786-0 | 0.0 | 0.0 |
| Renal ca. A498 | 4.4 | 6.0 |
| Renal ca. RXF 393 | 1.1 | 0.0 |
| Renal ca. ACHN | 0.3 | 0.0 |
| Renal ca. UO-31 | 5.1 | 12.5 |
| Renal ca. TK-10 | 0.0 | 0.0 |
| Liver | 0.0 | 0.0 |
| Liver (fetal) | 0.0 | 0.0 |
| Liver ca. (hepatoblast) HepG2 | 0.0 | 0.0 |
| Lung | 0.6 | 0.0 |
| Lung (fetal) | 1.0 | 2.4 |
| Lung ca. (small cell) LX-1 | 0.0 | 0.0 |
| Lung ca. (small cell) NCI-H69 | 6.3 | 4.9 |
| Lung ca. (s.cell var.) SHP-77 | 0.0 | 0.0 |
| Lung ca. (large cell) NCI-H460 | 1.7 | 4.1 |
| Lung ca. (non-sm. cell) A549 | 0.0 | 0.0 |
| Lung ca. (non-s.cell) NCI-H23 | 0.7 | 0.0 |
| Lung ca. (non-s.cell) HOP-62 | 0.0 | 0.0 |
| Lung ca. (non-s.cl) NCI-H522 | 0.0 | 0.0 |
| Lung ca. (squam.) SW 900 | 0.0 | 0.0 |
| Lung ca. (squam.) NCI-H596 | 0.9 | 0.0 |
| Mammary gland | 1.3 | 1.2 |
| Breast ca.* (pl.ef) MCF-7 | 0.0 | 0.0 |
| Breast ca.* (pl.ef) MDA-MB-231 | 0.7 | 4.6 |
| Breast ca.* (pl.ef) T47D | 0.0 | 0.0 |
| Breast ca. BT-549 | 0.3 | 7.6 |
| Breast ca. MDA-N | 0.0 | 1.4 |
| Ovary | 0.0 | 0.0 |
| Ovarian ca. OVCAR-3 | 0.0 | 0.0 |
| Ovarian ca. OVCAR-4 | 0.3 | 0.0 |
| Ovarian ca. OVCAR-5 | 0.3 | 0.0 |
| Ovarian ca. OVCAR-8 | 0.0 | 0.8 |
| Ovarian ca. IGROV-1 | 1.9 | 2.4 |
| Ovarian ca.* (ascites) SK-OV-3 | 0.4 | 3.5 |
| Uterus | 0.6 | 0.0 |
| Placenta | 0.0 | 0.0 |
| Prostate | 0.0 | 0.0 |
| Prostate ca.* (bone met) PC-3 | 0.0 | 0.9 |
| Testis | 0.8 | 1.6 |
| Melanoma Hs688(A).T | 4.3 | 1.6 |
| Melanoma* (met) Hs688 (B).T | 3.1 | 0.0 |
| Melanoma UACC-62 | 1.1 | 0.0 |
| Melanoma M14 | 0.0 | 0.0 |
| Melanoma LOX IMVI | 46.3 | 21.5 |
| Melanoma* (met) SK-MEL-5 | 0.0 | 1.1 |
| Adipose | 1.1 | 1.1 |

TABLE BC

Panel 2D

| Tissue Name | Rel. Exp. (%) Ag2944, Run 162373958 |
|---|---|
| Normal Colon | 30.6 |
| CC Well to Mod Diff (ODO3866) | 16.3 |
| CC Margin (ODO3866) | 8.7 |
| CC Gr.2 rectosigmoid (ODO3868) | 0.0 |
| CC Margin (ODO3868) | 0.0 |
| CC Mod Diff (ODO3920) | 0.0 |
| CC Margin (ODO3920) | 0.0 |
| CC Gr.2 ascend colon (ODO3921) | 0.0 |
| CC Margin (ODO3921) | 7.6 |
| CC from Partial Hepatectomy (ODO4309) Mets | 5.8 |
| Liver Margin (ODO4309) | 25.0 |
| Colon mets to lung (OD04451-01) | 5.6 |
| Lung Margin (OD04451-02) | 0.0 |
| Normal Prostate 6546-1 | 13.0 |
| Prostate Cancer (OD04410) | 13.9 |

TABLE BC-continued

Panel 2D

| Tissue Name | Rel. Exp. (%) Ag2944, Run 162373958 |
|---|---|
| Prostate Margin (OD04410) | 25.0 |
| Prostate Cancer (OD04720-01) | 3.4 |
| Prostate Margin (OD04720-02) | 22.7 |
| Normal Lung 061010 | 29.7 |
| Lung Met to Muscle (ODO4286) | 12.4 |
| Muscle Margin (ODO4286) | 0.0 |
| Lung Malignant Cancer (OD03126) | 0.0 |
| Lung Margin (OD03126) | 25.7 |
| Lung Cancer (OD04404) | 0.0 |
| Lung Margin (OD04404) | 0.0 |
| Lung Cancer (OD04565) | 4.5 |
| Lung Margin (OD04565) | 5.3 |
| Lung Cancer (OD04237-01) | 19.2 |
| Lung Margin (OD04237-02) | 0.0 |
| Ocular Mel Met Liver (ODO4310) | 100.0 |
| Liver Margin (ODO4310) | 6.4 |
| Melanoma Mets to Lung (OD04321) | 43.2 |
| Lung Margin (OD04321) | 4.1 |
| Normal Kidney | 7.4 |
| Kidney Ca, Nuclear grade 2 (OD04338) | 0.0 |
| Kidney Margin (OD04338) | 2.6 |
| Kidney Ca Nuclear grade 1/2 (OD04339) | 0.0 |
| Kidney Margin (OD04339) | 3.2 |
| Kidney Ca, Clear cell type (OD04340) | 0.0 |
| Kidney Margin (OD04340) | 5.5 |
| Kidney Ca, Nuclear grade 3 (OD04348) | 0.0 |
| Kidney Margin (OD04348) | 7.5 |
| Kidney Cancer (OD04622-01) | 9.1 |
| Kidney Margin (OD04622-03) | 0.0 |
| Kidney Cancer (OD04450-01) | 6.9 |
| Kidney Margin (OD04450-03) | 3.1 |
| Kidney Cancer 8120607 | 0.0 |
| Kidney Margin 8120608 | 0.0 |
| Kidney Cancer 8120613 | 0.0 |
| Kidney Margin 8120614 | 0.0 |
| Kidney Cancer 9010320 | 10.7 |
| Kidney Margin 9010321 | 0.0 |
| Normal Uterus | 5.1 |
| Uterus Cancer 064011 | 10.8 |
| Normal Thyroid | 4.9 |
| Thyroid Cancer 064010 | 3.8 |
| Thyroid Cancer A302152 | 8.5 |
| Thyroid Margin A302153 | 0.0 |
| Normal Breast | 11.5 |
| Breast Cancer (OD04566) | 0.0 |
| Breast Cancer (OD04590-01) | 7.1 |
| Breast Cancer Mets (OD04590-03) | 0.0 |
| Breast Cancer Metastasis (OD04655-05) | 50.7 |
| Breast Cancer 064006 | 30.8 |
| Breast Cancer 1024 | 50.3 |
| Breast Cancer 9100266 | 16.8 |
| Breast Margin 9100265 | 4.8 |
| Breast Cancer A209073 | 5.1 |
| Breast Margin A2090734 | 32.1 |
| Normal Liver | 13.3 |
| Liver Cancer 064003 | 9.8 |
| Liver Cancer 1025 | 11.5 |
| Liver Cancer 1026 | 0.0 |
| Liver Cancer 6004-T | 4.2 |
| Liver Tissue 6004-N | 15.9 |
| Liver Cancer 6005-T | 0.0 |
| Liver Tissue 6005-N | 0.0 |
| Normal Bladder | 35.1 |
| Bladder Cancer 1023 | 13.0 |
| Bladder Cancer A302173 | 11.5 |
| Bladder Cancer (OD04718-01) | 6.9 |
| Bladder Normal Adjacent (OD04718-03) | 19.3 |
| Normal Ovary | 0.0 |
| Ovarian Cancer 064008 | 47.3 |
| Ovarian Cancer (OD04768-07) | 0.0 |
| Ovary Margin (OD04768-08) | 29.5 |
| Normal Stomach | 54.0 |
| Gastric Cancer 9060358 | 0.0 |
| Stomach Margin 9060359 | 3.3 |
| Gastric Cancer 9060395 | 10.0 |
| Stomach Margin 9060394 | 59.5 |
| Gastric Cancer 9060397 | 12.9 |
| Stomach Margin 9060396 | 9.3 |
| Gastric Cancer 064005 | 47.6 |

TABLE BD

Panel 3D

| Tissue Name | Rel. Exp. (%) Ag2944, Run 164843788 |
|---|---|
| Daoy- Medulloblastoma | 0.6 |
| TE671- Medulloblastoma | 0.3 |

TABLE BD-continued

Panel 3D

| Tissue Name | Rel. Exp. (%) Ag2944, Run 164843788 |
|---|---|
| D283 Med- Medulloblastoma | 0.9 |
| PFSK-1- Primitive Neuroectodermal | 0.0 |
| XF-498- CNS | 1.7 |
| SNB-78- Glioma | 3.4 |
| SF-268- Glioblastoma | 6.7 |
| T98G- Glioblastoma | 1.0 |
| SK-N-SH- Neuroblastoma (metastasis) | 7.9 |
| SF-295- Glioblastoma | 2.0 |
| Cerebellum | 8.1 |
| Cerebellum | 1.2 |
| NCI-H292- Mucoepidermoid lung carcinoma | 1.1 |
| DMS-114- Small cell lung cancer | 1.3 |
| DMS-79- Small cell lung cancer | 0.0 |
| NCI-H146- Small cell lung cancer | 0.0 |
| NCI-H526- Small cell lung cancer | 0.0 |
| NCI-N417- Small cell lung cancer | 0.0 |
| NCI-H82- Small cell lung cancer | 0.6 |
| NCI-H157- Squamous cell lung cancer (metastasis) | 0.0 |
| NCI-H1155- Large cell lung cancer | 0.0 |
| NCI-H1299- Large cell lung cancer | 24.0 |
| NCI-H727- Lung carcinoid | 0.0 |
| NCI-UMC-11- Lung carcinoid | 1.7 |
| LX-1- Small cell lung cancer | 0.0 |
| Colo-205- Colon cancer | 0.0 |
| KM12- Colon cancer | 0.0 |
| KM20L2- Colon cancer | 0.0 |
| NCI-H716- Colon cancer | 0.0 |
| SW-48- Colon adenocarcinoma | 0.0 |
| SW1116- Colon adenocarcinoma | 0.0 |
| LS 174T-Colon adenocarcinoma | 0.0 |
| SW-948- Colon adenocarcinoma | 0.0 |
| SW-480- Colon adenocarcinoma | 0.0 |
| NCI-SNU-5- Gastric carcinoma | 0.0 |
| KATO III- Gastric carcinoma | 0.0 |
| NCI-SNU-16- Gastric carcinoma | 16.0 |
| NCI-SNU-1- Gastric carcinoma | 0.0 |
| RF-1- Gastric adenocarcinoma | 0.0 |
| RF-48- Gastric adenocarcinoma | 0.0 |
| MKN-45- Gastric carcinoma | 0.0 |
| NCI-N87- Gastric carcinoma | 0.0 |
| OVCAR-5- Ovarian carcinoma | 0.0 |
| RL95-2- Uterine carcinoma | 0.0 |
| HelaS3- Cervical adenocarcinoma | 0.0 |
| Ca Ski- Cervical epidermoid carcinoma (metastasis) | 0.0 |
| ES-2- Ovarian clear cell carcinoma | 100.0 |
| RAmos- Stimulated with PMA/ionomycin 6h | 0.0 |
| Ramos- Stimulated with PMA/ionomycin 14h | 0.2 |
| MEG-01- Chronic myelogenous leukemia (megokaryoblast) | 0.2 |
| Raji- Burkitt's lymphoma | 0.0 |
| Daudi- Burkitt's lymphoma | 0.0 |
| U266- B-cell plasmacytoma | 0.4 |
| CA46- Burkitt's lymphoma | 0.0 |
| RL- non-Hodgkin's B-cell lymphoma | 0.0 |
| JM1- pre-B-cell lymphoma | 0.0 |
| Jurkat- T cell leukemia | 0.0 |
| TF-1- Erythroleukemia | 1.0 |
| HUT 78- T-cell lymphoma | 0.0 |
| U937- Histiocytic lymphoma | 0.0 |
| KU-812- Myelogenous leukemia | 0.0 |
| 769-P- Clear cell renal carcinoma | 0.0 |
| Caki-2- Clear cell renal carcinoma | 0.0 |
| SW 839- Clear cell renal carcinoma | 1.1 |
| G401- Wilms' tumor | 17.3 |
| Hs766T- Pancreatic carcinoma (LN metastasis) | 0.6 |
| CAPAN-1- Pancreatic adenocarcinoma (liver metastasis) | 0.0 |
| SU86.86- Pancreatic carcinoma (liver metastasis) | 3.5 |
| BxPC-3- Pancreatic adenocarcinoma | 1.2 |
| HPAC- Pancreatic adenocarcinoma | 0.5 |
| MIA PaCa-2- Pancreatic carcinoma | 0.0 |
| CFPAC-1- Pancreatic ductal adenocarcinoma | 0.8 |
| PANC-1- Pancreatic epithelioid ductal carcinoma | 0.0 |
| T24- Bladder carcinoma (transitional cell) | 1.0 |
| 5637- Bladder carcinoma | 0.7 |
| HT-1197- Bladder carcinoma | 0.3 |
| UM-UC-3- Bladder carcinoma (transitional cell) | 1.0 |
| A204- Rhabdomyosarcoma | 0.0 |
| HT-1080- Fibrosarcoma | 18.9 |
| MG-63- Osteosarcoma | 7.4 |
| SK-LMS-1- Leiomyosarcoma (vulva) | 21.6 |
| SJRH30- Rhabdomyosarcoma (met to bone marrow) | 0.0 |
| A431- Epidermoid carcinoma | 0.0 |
| WM266-4- Melanoma | 4.0 |
| DU 145- Prostate carcinoma (brain metastasis) | 0.0 |
| MDA-MB-468- Breast adenocarcinoma | 0.0 |

TABLE BD-continued

Panel 3D

| Tissue Name | Rel. Exp. (%) Ag2944, Run 164843788 |
|---|---|
| SCC-4- Squamous cell carcinoma of tongue | 1.0 |
| SCC-9- Squamous cell carcinoma of tongue | 0.4 |
| SCC-15- Squamous cell carcinoma of tongue | 0.0 |
| CAL 27- Squamous cell carcinoma of tongue | 0.0 |

TABLE BE

Panel 4D

| Tissue Name | Rel. Exp. (%) Ag2944, Run 159843300 |
|---|---|
| Secondary Th1 act | 0.0 |
| Secondary Th2 act | 0.0 |
| Secondary Tr1 act | 0.0 |
| Secondary Th1 rest | 0.0 |
| Secondary Th2 rest | 0.0 |
| Secondary Tr1 rest | 0.0 |
| Primary Th1 act | 0.0 |
| Primary Th2 act | 0.0 |
| Primary Tr1 act | 0.0 |
| Primary Th1 rest | 0.0 |
| Primary Th2 rest | 0.0 |
| Primary Tr1 rest | 0.0 |
| CD45RA CD4 lymphocyte act | 0.0 |
| CD45RO CD4 lymphocyte act | 0.0 |
| CD8 lymphocyte act | 0.4 |
| Secondary CD8 lymphocyte rest | 0.0 |
| Secondary CD8 lymphocyte act | 0.0 |
| CD4 lymphocyte none | 0.0 |
| 2ry Th1/Th2/Tr1_anti-CD95 CH11 | 0.0 |
| LAK cells rest | 0.0 |
| LAK cells IL-2 | 0.0 |
| LAK cells IL-2 + IL-12 | 0.0 |
| LAK cells IL-2 + IFN gamma | 0.0 |
| LAK cells IL-2 + IL-18 | 0.0 |
| LAK cells PMA/ionomycin | 0.0 |
| NK Cells IL-2 rest | 0.0 |
| Two Way MLR 3 day | 0.3 |
| Two Way MLR 5 day | 0.0 |
| Two Way MLR 7 day | 0.0 |
| PBMC rest | 0.0 |
| PBMC PWM | 0.0 |
| PBMC PHA-L | 0.0 |
| Ramos (B cell) none | 0.0 |
| Ramos (B cell) ionomycin | 0.0 |
| B lymphocytes PWM | 0.0 |
| B lymphocytes CD40L and IL-4 | 0.7 |
| EOL-1 dbcAMP | 0.7 |
| EOL-1 dbcAMP PMA/ionomycin | 0.0 |
| Dendritic cells none | 0.3 |
| Dendritic cells LPS | 0.0 |
| Dendritic cells anti-CD40 | 0.6 |
| Monocytes rest | 0.0 |

TABLE BE-continued

Panel 4D

| Tissue Name | Rel. Exp. (%) Ag2944, Run 159843300 |
|---|---|
| Monocytes LPS | 0.3 |
| Macrophages rest | 0.5 |
| Macrophages LPS | 0.8 |
| HUVEC none | 67.4 |
| HUVEC starved | 100.0 |
| HUVEC IL-1beta | 32.5 |
| HUVEC IFN gamma | 9.8 |
| HUVEC TNF alpha + IFN gamma | 28.3 |
| HUVEC TNF alpha + IL4 | 43.2 |
| HUVEC IL-11 | 9.0 |
| Lung Microvascular EC none | 11.9 |
| Lung Microvascular EC TNFalpha + IL-1beta | 23.7 |
| Microvascular Dermal EC none | 16.5 |
| Microsvascular Dermal EC TNFalpha + IL-1beta | 22.4 |
| Bronchial epithelium TNFalpha + IL1beta | 0.3 |
| Small airway epithelium none | 1.2 |
| Small airway epithelium TNFalpha + IL-1beta | 2.8 |
| Coronery artery SMC rest | 27.4 |
| Coronery artery SMC TNFalpha + IL-1beta | 0.0 |
| Astrocytes rest | 8.2 |
| Astrocytes TNFalpha + IL-1beta | 8.7 |
| KU-812 (Basophil) rest | 0.0 |
| KU-812 (Basophil) PMA/ionomycin | 0.3 |
| CCD1106 (Keratinocytes) none | 1.8 |
| CCD1106 (Keratinocytes) TNFalpha + IL-1beta | 0.0 |
| Liver cirrhosis | 0.9 |
| Lupus kidney | 0.0 |
| NCI-H292 none | 0.3 |
| NCI-H292 IL-4 | 0.7 |
| NCI-H292 IL-9 | 0.3 |
| NCI-H292 IL-13 | 0.0 |
| NCI-H292 IFN gamma | 0.0 |
| HPAEC none | 16.7 |
| HPAEC TNF alpha + IL-1 beta | 45.1 |
| Lung fibroblast none | 2.5 |
| Lung fibroblast TNF alpha + IL-1 beta | 0.9 |
| Lung fibroblast IL-4 | 1.5 |
| Lung fibroblast IL-9 | 4.2 |
| Lung fibroblast IL-13 | 0.0 |
| Lung fibroblast IFN gamma | 1.1 |
| Dermal fibroblast CCD1070 rest | 22.8 |
| Dermal fibroblast CCD1070 TNF alpha | 36.6 |
| Dermal fibroblast CCD1070 IL-1 beta | 14.0 |
| Dermal fibroblast IFN gamma | 2.4 |
| Dermal fibroblast IL-4 | 3.0 |
| IBD Colitis 2 | 0.6 |
| IBD Crohn's | 0.0 |
| Colon | 0.0 |
| Lung | 1.7 |
| Thymus | 0.3 |
| Kidney | 0.6 |

Panel 1.3D Summary: Ag2944 Two experiments with the same probe and primer set produce results that are in excellent agreement, with significant expression of the CG56275-01 gene restricted to cancer cell lines. Highest expression of this gene is seen in a cluster of brain cancer lines (CTs=32–34). Moderate levels of expression are also detected in a melanoma cell line. Thus, expression of this gene could be used to differentiate these samples from other samples on this panel and as a marker to detect the presence of these cancers. The protein encoded by this gene is homologous to guanylate kinase, an important enzyme in nucleotide metabolic pathways. This molecule is a known target for several chemotherapeutic agents. Therefore, therapeutic modulation of the expression or function of this novel gene could be effective in the treatment of brain cancer and melanoma.

REFERENCES

Stolworthy TS, Black M E. The mouse guanylate kinase double mutant E72Q/D103N is a functional adenylate kinase. Protein Eng 2001 November; 14(11):903–909.

Guanylate kinase catalyzes the phosphorylation of either GMP to GDP or dGMP to dGDP and is an important enzyme in nucleotide metabolic pathways. Because of its essential intracellular role, guanylate kinase is a target for a number of cancer chemotherapeutic agents such as 6-thioguanine and 8-azaguanine and is involved in antiviral drug activation. Guanylate kinase shares a similarity in function and structure to other nucleoside monophosphate kinases especially with that of the well-studied adenylate kinase. Amino acid substitutions were made within the GMP binding site of mouse guanylate kinase to alter the polarity of the side chains that interact with GMP as a means of evaluating the role that these residues play on substrate interaction. One of these mutants, E72Q/D103N, was shown by functional complementation and enzyme assays to embody both guanylate kinase activity and a novel adenylate kinase activity.
PMID: 11742110

Hoover K B, Liao S Y, Bryant P J. Loss of the tight junction MAGUK ZO-1 in breast cancer: relationship to glandular differentiation and loss of heterozygosity. Am J Pathol 1998 December; 153(6):1767–73

Membrane-associated guanylate kinase homologs (MAGUKs) may play a role in cellular functions preventing tumorigenesis as indicated by the neoplastic phenotype caused by genetic loss of the MAGUK Dlg in *Drosophila*. To test this possibility, we examined the expression and subcellular localization of the tight junction MAGUK ZO-1, as well as the cell adhesion molecule E-cadherin, in paraffin-embedded breast cancer samples, using immunohistochemistry and confocal microscopy. As expected, normal tissue showed intense staining for ZO-1 at the position of the epithelial tight junctions, but this staining was reduced or lost in 69% of breast cancers analyzed (n=48). In infiltrating ductal carcinomas (n=38) there was a reduction in staining in 42% of well differentiated, in 83% of moderately differentiated and 93% of poorly differentiated tumors. ZO-1 staining was positively correlated with tumor differentiation (P=0.011) and more specifically with the glandular differentiation of tumors (P=0.0019). Reduction in ZO-1 staining was strongly correlated with reduced E-cadherin staining (P=4.9×10(−5)). The results suggest that down-regulation of ZO-1 expression and its failure to accumulate at cell junctions may be causally related to cancer progression. To detect loss of heterozygosity, the ZO-1 gene tjp-1 was mapped relative to other markers in 15q13 and polymorphic markers flanking tjp-1 were identified. The marker D15S1019 showed loss of heterozygosity in 23% of informative tumors (n=13). Loss of a tjp-1-linked marker suggests that genetic loss may, in some cases, be responsible for the reduction in ZO-1 expression in breast cancer.
PMID: 9846967

Panel 2D Summary: Ag2944 Significant expression of the CG56275-01 gene is restricted to a sample derived from an ocular melanoma metastasis to the liver (CT=34). Thus, expression of this gene could be used to differentiate between this sample and other samples on this panel and as a marker to detect this form of cancer.

Panel 3D Summary: Ag2944 Highest expression of the CG56275-01 gene in this panel is seen in an ovarian cancer cell line (CT=30.10). Significant expression is also seen in a gastric cancer cell line and a lung cancer cell line. Thus, expression of this gene could be used to differentiate between these samples and other samples on this panel.

Panel 4D Summary: Ag2944 The CG56275-01 transcript is expressed in fibroblasts and endothelial cells regardless of treatment. This transcript encodes a putative guanylate kinase that may be needed for the normal function of the cells that express this protein. Thus, the transcript or the protein it encodes could be used to identify endothelium or fibroblasts. Furthermore, regulation of the transcript or the protein it encodes could be important in maintaining normal cellular homeostasis and in the treatment of inflammation, asthma, emphysema, arthritis, IBD or psoriasis.

NOV3a: CG53400-01: Hypothetical 85.6 kDa Human Protein

Expression of gene CG53400-01 was assessed using the primer-probe set Ag2579, described in Table CA. Results of the RTQ-PCR runs are shown in Tables CB, CC, CD and CE.

TABLE CA

Probe Name Ag2579

| Primers | Sequences | Length | Start Position |
|---------|-----------|--------|----------------|
| Forward | 5'-gccttatcaatgctaccaacag-3' (SEQ ID NO:347) | 22 | 2830 |
| Probe | TET-5'-ctgcagatgccactccacattgct-3'-TAMRA (SEQ ID NO:348) | 24 | 2856 |
| Reverse | 5'-gcctgtaccacagaagctagac-3' (SEQ ID NO:349) | 22 | 2890 |

TABLE CB

CNS_neurodegeneration_v1.0

| Tissue Name | Rel. Exp. (%) Ag2579, Run 208777161 |
|-------------|--------------------------------------|
| AD 1 Hippo | 17.2 |
| AD 2 Hippo | 28.3 |
| AD 3 Hippo | 10.7 |
| AD 4 Hippo | 9.5 |
| AD 5 hippo | 92.7 |
| AD 6 Hippo | 95.3 |
| Control 2 Hippo | 28.7 |
| Control 4 Hippo | 12.9 |
| Control (Path) 3 Hippo | 7.3 |
| AD 1 Temporal Ctx | 22.2 |
| AD 2 Temporal Ctx | 31.2 |
| AD 3 Temporal Ctx | 10.7 |
| AD 4 Temporal Ctx | 26.4 |

TABLE CB-continued

CNS_neurodegeneration_v1.0

| Tissue Name | Rel. Exp. (%) Ag2579, Run 208777161 |
|---|---|
| AD 5 Inf Temporal Ctx | 91.4 |
| AD 5 SupTemporal Ctx | 42.9 |
| AD 6 Inf Temporal Ctx | 69.3 |
| AD 6 Sup Temporal Ctx | 80.7 |
| Control 1 Temporal Ctx | 5.1 |
| Control 2 Temporal Ctx | 46.3 |
| Control 3 Temporal Ctx | 15.5 |
| Control 4 Temporal Ctx | 10.9 |
| Control (Path) 1 Temporal Ctx | 73.7 |
| Control (Path) 2 Temporal Ctx | 40.1 |
| Control (Path) 3 Temporal Ctx | 4.4 |
| Control (Path) 4 Temporal Ctx | 31.2 |
| AD 1 Occipital Ctx | 13.8 |
| AD 2 Occipital Ctx (Missing) | 0.0 |
| AD 3 Occipital Ctx | 7.4 |
| AD 4 Occipital Ctx | 24.8 |
| AD 5 Occipital Ctx | 8.7 |
| AD 6 Occipital Ctx | 40.9 |
| Control 1 Occipital Ctx | 5.4 |
| Control 2 Occipital Ctx | 63.7 |
| Control 3 Occipital Ctx | 16.4 |
| Control 4 Occipital Ctx | 9.0 |
| Control (Path) 1 Occipital Ctx | 100.0 |
| Control (Path) 2 Occipital Ctx | 7.1 |
| Control (Path) 3 Occipital Ctx | 4.6 |
| Control (Path) 4 Occipital Ctx | 18.4 |
| Control 1 Parietal Ctx | 6.4 |
| Control 2 Parietal Ctx | 41.2 |
| Control 3 Parietal Ctx | 22.1 |
| Control (Path) 1 Parietal Ctx | 92.0 |
| Control (Path) 2 Parietal Ctx | 20.7 |
| Control (Path) 3 Parietal Ctx | 6.7 |
| Control (Path) 4 Parietal Ctx | 39.2 |

TABLE CC

Panel 1.3D

| Tissue Name | Rel. Exp. (%) Ag2579, Run 166190504 |
|---|---|
| Liver adenocarcinoma | 64.2 |
| Pancreas | 7.1 |
| Pancreatic ca. CAPAN 2 | 20.0 |
| Adrenal gland | 13.9 |
| Thyroid | 3.8 |
| Salivary gland | 14.0 |
| Pituitary gland | 15.9 |
| Brain (fetal) | 28.5 |
| Brain (whole) | 79.0 |
| Brain (amygdala) | 43.8 |
| Brain (cerebellum) | 55.1 |
| Brain (hippocampus) | 34.4 |
| Brain (substantia nigra) | 17.8 |
| Brain (thalamus) | 78.5 |
| Cerebral Cortex | 58.6 |
| Spinal cord | 17.0 |
| glio/astro U87-MG | 51.8 |
| glio/astro U-118-MG | 60.7 |
| astrocytoma SW1783 | 36.3 |
| neuro*; met SK-N-AS | 30.8 |
| astrocytoma SF-539 | 48.0 |
| astrocytoma SNB-75 | 30.6 |
| glioma SNB-19 | 35.8 |
| glioma U251 | 22.5 |
| glioma SF-295 | 17.8 |
| Heart (fetal) | 12.7 |
| Heart | 6.3 |
| Skeletal muscle (fetal) | 11.2 |
| Skeletal muscle | 22.8 |
| Bone marrow | 5.7 |
| Thymus | 14.1 |
| Spleen | 11.1 |
| Lymph node | 10.2 |
| Colorectal | 14.6 |
| Stomach | 9.5 |
| Small intestine | 13.8 |
| Colon ca. SW480 | 27.5 |
| Colon ca.* SW620 (SW480 met) | 18.9 |
| Colon ca. HT29 | 1.7 |
| Colon ca. HCT-116 | 14.1 |
| Colon ca. CaCo-2 | 13.8 |
| Colon ca. tissue (ODO3866) | 16.0 |
| Colon ca. HCC-2998 | 15.2 |
| Gastric ca.* (liver met) NCI-N87 | 14.0 |
| Bladder | 14.5 |
| Trachea | 6.7 |
| Kidney | 8.7 |
| Kidney (fetal) | 13.4 |
| Renal ca. 786-0 | 39.2 |
| Renal ca. A498 | 39.8 |
| Renal ca. RXF 393 | 34.9 |
| Renal ca. ACHN | 27.0 |
| Renal ca. UO-31 | 40.6 |
| Renal ca. TK-10 | 10.4 |
| Liver | 1.1 |
| Liver (fetal) | 8.9 |
| Liver ca. (hepatoblast) HepG2 | 18.7 |
| Lung | 2.6 |
| Lung (fetal) | 15.4 |
| Lung ca. (small cell) LX-1 | 26.6 |
| Lung ca. (small cell) NCI-H69 | 17.2 |
| Lung ca. (s.cell var.) SHP-77 | 21.8 |
| Lung ca. (large cell) NCI-H460 | 11.4 |
| Lung ca. (non-sm. cell) A549 | 12.2 |
| Lung ca. (non-s.cell) NCI-H23 | 24.5 |

TABLE CC-continued

Panel 1.3D

| Tissue Name | Rel. Exp. (%) Ag2579, Run 166190504 |
|---|---|
| Lung ca. (non-s.cell) HOP-62 | 17.3 |
| Lung ca. (non-s.cl) NCI-H522 | 14.2 |
| Lung ca. (squam.) SW 900 | 22.5 |
| Lung ca. (squam.) NCI-H596 | 7.7 |
| Mammary gland | 10.7 |
| Breast ca.* (pl.ef) MCF-7 | 35.1 |
| Breast ca.* (pl.ef) MDA-MB-231 | 35.6 |
| Breast ca.* (pl.ef) T47D | 13.5 |
| Breast ca. BT-549 | 13.5 |
| Breast ca. MDA-N | 7.5 |
| Ovary | 12.1 |
| Ovarian ca. OVCAR-3 | 19.2 |
| Ovarian ca. OVCAR-4 | 31.4 |
| Ovarian ca. OVCAR-5 | 13.4 |
| Ovarian ca. OVCAR-8 | 12.3 |
| Ovarian ca. IGROV-1 | 17.7 |
| Ovarian ca.* (ascites) SK-OV-3 | 100.0 |
| Uterus | 5.2 |
| Placenta | 29.7 |
| Prostate | 4.5 |
| Prostate ca.* (bone met) PC-3 | 29.9 |
| Testis | 11.8 |
| Melanoma Hs688(A).T | 9.9 |
| Melanoma* (met) Hs688(B).T | 16.6 |
| Melanoma UACC-62 | 49.3 |
| Melanoma M14 | 11.7 |
| Melanoma LOX IMVI | 11.4 |
| Melanoma* (met) SK-MEL-5 | 17.3 |
| Adipose | 3.1 |

TABLE CD

Panel 2.2

| Tissue Name | Rel. Exp. (%) Ag2579, Run 174923041 |
|---|---|
| Normal Colon | 27.2 |
| Colon cancer (OD06064) | 51.1 |
| Colon Margin (OD06064) | 20.7 |
| Colon cancer (OD06159) | 7.9 |
| Colon Margin (OD06159) | 22.2 |
| Colon cancer (OD06297-04) | 12.3 |
| Colon Margin (OD06297-015) | 48.0 |
| CC Gr.2 ascend colon (ODO3921) | 13.5 |
| CC Margin (ODO3921) | 12.4 |
| Colon cancer metastasis (OD06104) | 6.4 |

TABLE CD-continued

Panel 2.2

| Tissue Name | Rel. Exp. (%) Ag2579, Run 174923041 |
|---|---|
| Lung Margin (OD06104) | 12.8 |
| Colon mets to lung (OD04451-01) | 20.4 |
| Lung Margin (OD04451-02) | 11.9 |
| Normal Prostate | 16.8 |
| Prostate Cancer (OD04410) | 100.0 |
| Prostate Margin (OD04410) | 11.9 |
| Normal Ovary | 36.3 |
| Ovarian cancer (OD06283-03) | 35.8 |
| Ovarian Margin (OD06283-07) | 18.4 |
| Ovarian Cancer 064008 | 9.9 |
| Ovarian cancer (OD06145) | 7.0 |
| Ovarian Margin (OD06145) | 18.6 |
| Ovarian cancer (OD06455-03) | 34.4 |
| Ovarian Margin (OD06455-07) | 10.6 |
| Normal Lung | 17.4 |
| Invasive poor diff. lung adeno (OD04945-01) | 13.8 |
| Lung Margin (ODO4945-03) | 14.8 |
| Lung Malignant Cancer (OD03126) | 15.5 |
| Lung Margin (OD03126) | 9.1 |
| Lung Cancer (OD05014A) | 27.5 |
| Lung Margin (OD05014B) | 26.4 |
| Lung cancer (OD06081) | 29.3 |
| Lung Margin (OD06081) | 4.5 |
| Lung Cancer (OD04237-01) | 12.6 |
| Lung Margin (OD04237-02) | 25.2 |
| Ocular Melanoma Metastasis | 26.6 |
| Ocular Melanoma Margin (Liver) | 2.2 |
| Melanoma Metastasis | 33.2 |
| Melonoma Margin (Lung) | 10.8 |
| Normal Kidney | 25.5 |
| Kidney Ca, Nuclear grade 2 (OD04338) | 57.4 |
| Kidney Margin (OD04338) | 25.9 |
| Kidney Ca Nuclear grade 1/2 (OD04339) | 31.2 |
| Kidney Margin (OD04339) | 20.2 |
| Kidney Ca, Clear cell type (OD04340) | 9.3 |
| Kidney Margin (OD04340) | 21.8 |
| Kidney Ca, Nuclear grade 3 (OD04348) | 15.6 |
| Kidney Margin (OD04348) | 90.1 |
| Kidney malignant cancer (OD06204B) | 20.2 |
| Kidney normal adjacent tissue (OD06204E) | 43.8 |
| Kidney Cancer (OD04450-01) | 52.5 |

TABLE CD-continued

Panel 2.2

| Tissue Name | Rel. Exp. (%) Ag2579, Run 174923041 |
|---|---|
| Kidney Margin (OD04450-03) | 29.3 |
| Kidney Cancer 8120613 | 2.2 |
| Kidney Margin 8120614 | 36.1 |
| Kidney Cancer 9010320 | 16.8 |
| Kidney Margin 9010321 | 18.0 |
| Kidney Cancer 8120607 | 37.4 |
| Kidney Margin 8120608 | 15.7 |
| Normal Uterus | 28.3 |
| Uterine Cancer 064011 | 15.4 |
| Normal Thyroid | 7.3 |
| Thyroid Cancer 064010 | 17.6 |
| Thyroid Cancer A302152 | 34.2 |
| Thyroid Margin A302153 | 8.2 |
| Normal Breast | 26.4 |
| Breast Cancer (OD04566) | 6.8 |
| Breast Cancer 1024 | 62.4 |
| Breast Cancer (OD04590-01) | 40.9 |
| Breast Cancer Mets (OD04590-03) | 25.3 |
| Breast Cancer Metastasis (OD04655-05) | 46.7 |
| Breast Cancer 064006 | 20.3 |
| Breast Cancer 9100266 | 62.0 |
| Breast Margin 9100265 | 21.9 |
| Breast Cancer A209073 | 15.9 |
| Breast Margin A2090734 | 27.7 |
| Breast Cancer (OD06083) | 53.6 |
| Breast Cancer node metastasis (OD06083) | 33.4 |
| Normal Liver | 18.7 |
| Liver Cancer 1026 | 23.8 |
| Liver Cancer 1025 | 18.4 |
| Liver Cancer 6004-T | 15.6 |
| Liver Tissue 6004-N | 5.4 |
| Liver Cancer 6005-T | 44.8 |
| Liver Tissue 6005-N | 16.8 |
| Liver Cancer 064003 | 20.4 |
| Normal Bladder | 17.8 |
| Bladder Cancer 1023 | 24.3 |
| Bladder Cancer A302173 | 35.1 |
| Normal Stomach | 48.6 |
| Gastric Cancer 9060397 | 14.7 |
| Stomach Margin 9060396 | 18.2 |
| Gastric Cancer 9060395 | 22.1 |
| Stomach Margin 9060394 | 35.6 |
| Gastric Cancer 064005 | 20.6 |

TABLE CE

Panel 4D

| Tissue Name | Rel. Exp. (%) Ag2579, Run 164331536 |
|---|---|
| Secondary Th1 act | 28.9 |
| Secondary Th2 act | 42.9 |
| Secondary Tr1 act | 29.9 |
| Secondary Th1 rest | 4.2 |

TABLE CE-continued

Panel 4D

| Tissue Name | Rel. Exp. (%) Ag2579, Run 164331536 |
|---|---|
| Secondary Th2 rest | 10.5 |
| Secondary Tr1 rest | 8.2 |
| Primary Th1 act | 39.0 |
| Primary Th2 act | 23.3 |
| Primary Tr1 act | 33.4 |
| Primary Th1 rest | 41.8 |
| Primary Th2 rest | 23.5 |
| Primary Tr1 rest | 19.2 |
| CD45RA CD4 lymphocyte act | 19.9 |
| CD45RO CD4 lymphocyte act | 31.2 |
| CD8 lymphocyte act | 14.3 |
| Secondary CD8 lymphocyte rest | 22.1 |
| Secondary CD8 lymphocyte act | 14.9 |
| CD4 lymphocyte none | 3.6 |
| 2ry Th1/Th2/Tr1_anti-CD95 CH11 | 12.1 |
| LAK cells rest | 14.1 |
| LAK cells IL-2 | 20.3 |
| LAK cells IL-2 + IL-12 | 21.2 |
| LAK cells IL-2 + IFN gamma | 33.7 |
| LAK cells IL-2 + IL-18 | 22.2 |
| LAK cells PMA/ionomycin | 3.4 |
| NK Cells IL-2 rest | 13.3 |
| Two Way MLR 3 day | 11.8 |
| Two Way MLR 5 day | 16.7 |
| Two Way MLR 7 day | 13.2 |
| PBMC rest | 3.6 |
| PBMC PWM | 94.6 |
| PBMC PHA-L | 28.1 |
| Ramos (B cell) none | 15.0 |
| Ramos (B cell) ionomycin | 67.8 |
| B lymphocytes PWM | 49.3 |
| B lymphocytes CD40L and IL-4 | 23.7 |
| EOL-1 dbcAMP | 8.8 |
| EOL-1 dbcAMP PMA/ionomycin | 7.2 |
| Dendritic cells none | 12.0 |
| Dendritic cells LPS | 13.2 |
| Dendritic cells anti-CD40 | 15.4 |
| Monocytes rest | 5.5 |
| Monocytes LPS | 11.1 |
| Macrophages rest | 19.9 |
| Macrophages LPS | 9.0 |
| HUVEC none | 24.3 |
| HUVEC starved | 50.0 |
| HUVEC IL-1beta | 14.9 |
| HUVEC IFN gamma | 23.2 |
| HUVEC TNF alpha + IFN gamma | 22.4 |
| HUVEC TNF alpha + IL4 | 22.7 |
| HUVEC IL-11 | 11.1 |
| Lung Microvascular EC none | 24.0 |
| Lung Microvascular EC TNFalpha + IL-1beta | 24.8 |
| Microvascular Dermal EC none | 23.7 |
| Microvasular Dermal EC TNFalpha + IL-1beta | 19.6 |
| Bronchial epithelium TNFalpha + IL1beta | 16.6 |
| Small airway epithelium none | 7.5 |

TABLE CE-continued

Panel 4D

| Tissue Name | Rel. Exp. (%) Ag2579, Run 164331536 |
|---|---|
| Small airway epithelium TNFalpha + IL-1beta | 49.0 |
| Coronery artery SMC rest | 24.1 |
| Coronery artrey SMC TNFalpha + IL-1beta | 9.9 |
| Astrocytes rest | 42.6 |
| Astrocytes TNFalpha + IL-1beta | 28.9 |
| KU-812 (Basophil) rest | 5.1 |
| KU-812 (Basophil) PMA/ionomycin | 18.8 |
| CCD1106 (Keratinocytes) none | 22.8 |
| CCD1106 (Keratinocytes) TNFalpha + IL-1beta | 15.2 |
| Liver cirrhosis | 1.5 |
| Lupus kidney | 3.9 |
| NCI-H292 none | 27.7 |
| NCI-H292 IL-4 | 26.1 |
| NCI-H292 IL-9 | 61.1 |
| NCI-H292 IL-13 | 34.6 |
| NCI-H292 IFN gamma | 27.9 |
| HPAEC none | 13.1 |
| HPAEC TNF alpha + IL-1 beta | 17.4 |
| Lung fibroblast none | 12.9 |
| Lung fibroblast TNF alpha + IL-1 beta | 10.6 |
| Lung fibroblast IL-4 | 44.8 |
| Lung fibroblast IL-9 | 29.5 |
| Lung fibroblast IL-13 | 18.7 |
| Lung fibroblast IFN gamma | 42.0 |
| Dermal fibroblast CCD1070 rest | 89.5 |
| Dermal fibroblast CCD1070 TNF alpha | 100.0 |
| Dermal fibroblast CCD1070 IL-1 beta | 33.0 |
| Dermal fibroblast IFN gamma | 13.1 |
| Dermal fibroblast IL-4 | 29.7 |
| IBD Colitis 2 | 0.7 |
| IBD Crohn's | 0.6 |
| Colon | 13.5 |
| Lung | 9.7 |
| Thymus | 21.8 |
| Kidney | 21.0 |

CNS_neurodegeneration_v1.0 Summary: Ag2579 Expression of the CG53400-01 gene does not appear to show an association with Alzheimer's disease in this panel. However, this panel confirms the expression of this gene in the brain. Please see Panel 1.3D for discussion of utility of this gene in the central nervous system.

Panel 1.3D Summary: Ag2579 Expression of the CG53400-01 gene is ubiquitous in this panel, with highest expression in the ascites derived ovarian cancer cell line SK-OV-3 (CT=28.5). There is also significant expression of this gene in a cluster of cell lines derived from renal cancer and melanoma. The widespread expression of this gene suggests that the gene product may be involved in cell differentiation and growth. Thus, expression of this gene could be used to differentiate between the samples mentioned above and other samples on this panel. Expression of this gene could also potentially be used as a marker for ascites derived ovarian cancer, ascites derived tissue samples, melanoma and renal cancer. Furthermore, therapeutic modulation of the expression or function of this gene may be effective in the treatment of these cancers.

This gene is also widely expressed among tissues with metabolic function, including adipose, adult and fetal skeletal muscle and heart, the pancreas, fetal liver, and the adrenal, thyroid, and pituitary glands. This expression profile suggests that this gene product may also be involved in metabolic function and that therapeutic modulation of the expression or function of this gene may be effective in the treatment of metabolic disorders, such as obesity and diabetes.

In addition, this gene appears to be expressed at much higher levels in fetal liver (CT=32) than in adult liver (CT=35). Thus, expression of this gene could be used to differentiate between adult and fetal sources of liver tissue.

The expression profile of this gene also shows widespread expression of this gene in the brain. This suggests that the protein encoded by this gene may be important for normal neurological function. Therefore, modulation of the function or expression of this gene may be effective in the treatment of neurodegenerative disorders, such as Alzheimer's disease and Parkinson's disease.

Panel 2.2 Summary: Ag2579 Expression of the CG53400-01 gene is widespread in this panel, with highest expression in prostate cancer (CT=30.6). Furthermore, expression in prostate cancer is significantly higher than expression in the corresponding normal adjacent tissue. Conversely, expression of this gene is higher in normal kidney than in adjacent kidney tumor. Thus, expression of this gene could be used as a marker for kidney or prostate cancer. In addition, therapeutic modulation of the expression or function of this gene could be used in the treatment of kidney or prostate cancer.

Panel 4D Summary: Ag2579 The CG53400-01 gene is ubiquitously expressed in this panel, with highest in dermal fibroblasts treated with TNF-alpha (CT=26.3). Significant expression is also seen in untreated dermal fibroblasts and PBMC treated with the B the B cell mitogen, PWM. The expression of this gene in activated dermal fibroblast combined with moderate expression in the mucoepidermoid cell line H292, often used as a model for airway epithelium, suggest that therapeutic modulation of this gene might also be useful in the treatment of asthma and emphysema. In addition, the high levels of expression of this gene in activated B cells are significant because B cells represent a principle component of immunity and contribute to the immune response in a number of important functional roles, including antibody production. Furthermore, production of antibodies against self-antigens is a major component in autoimmune disorders.

Since B cells play an important role in autoimmunity, inflammatory processes and inflammatory cascades, therapeutic modulation of this gene product may therefore, reduce or eliminate the symptoms of patients suffering from asthma, allergies, chronic obstructive pulmonary disease, emphysema, Crohn's disease, ulcerative colitis, rheumatoid arthritis, psoriasis, osteoarthritis, and other autoimmune disorders including systemic lupus erythematosus.

NOV4a: CG56209-01: Mytonic Dystrophy Kinase-Related CDC42-Binding Kinase

Expression of gene CG56209-01 was assessed using the primer-probe set Ag4976, described in Table DA.

TABLE DA

Probe Name Ag4976

| Primers | Sequences | Length | Start Position |
|---|---|---|---|
| Forward | 5'-agcttagcctcagcgagttc-3' (SEQ ID NO:350) | 20 | 3039 |
| Probe | TET-5'-ctgctactcttcaccactgctggcat-3'-TAMRA (SEQ ID NO:351) | 26 | 3059 |
| Reverse | 5'-gttctcgctgaacagagacttg-3' (SEQ ID NO:352) | 22 | 3106 |

CNS_neurodegeneration v1.0 Summary: Ag4976 Expression of the CG56209-01 gene is low/undetectable in all samples on this panel. (CTs>35). (Data not shown.) The amp plot indicates that there is a high probability of a probe failure in this experiment.

General_screening_panel v1.5 Summary: Ag4976 Expression of the CG56209-01 gene is low/undetectable in all samples on this panel. (CTs>35). (Data not shown.) The amp plot indicates that there is a high probability of a probe failure in this experiment.

Panel 4.1D Summary: Ag4976 Expression of the CG56209-01 gene is low/undetectable in all samples on this panel. (CTs>35). (Data not shown.) The amp plot indicates that there is a high probability of a probe failure in this experiment.

NOV7a and NOV7b: CG50365-01 and CG50365-02: Carbonate Dehydratase

Expression of gene CG50365-01 and variant CG50365-02 was assessed using the primer-probe sets Ag2644 and Ag2575, described in Tables EA and EB. Results of the RTQ-PCR runs are shown in Tables EC, ED, EE, EF, and EG.

TABLE EA

Probe Name Ag2644

| Primers | Sequences | Length | Start Position |
|---|---|---|---|
| Forward | 5'-tcagcaatctccaattgagatt-3' (SEQ ID NO:353) | 22 | 96 |
| Probe | TET-5'-tgaaatatgactcttccctccgacca-3'-TAMRA (SEQ ID NO:354) | 26 | 131 |
| Reverse | 5'-ttttagctgagcttgggtcata-3' (SEQ ID NO:355) | 22 | 169 |

TABLE EB

Probe Name Ag2575

| Primers | Sequences | Length | Start Position |
|---|---|---|---|
| Forward | 5'-tcagcaatctccaattgagatt-3' (SEQ ID NO:356) | 22 | 96 |
| Probe | TET-5'-tgaaatatgactcttccctccgacca-3'-TAMRA (SEQ ID NO:357) | 26 | 131 |
| Reverse | 5'-ttttagctgagcttgggtcata-3' (SEQ ID NO:358) | 22 | 169 |

TABLE EC

CNS_neurodegeneration_v1.0

| Tissue Name | Rel. Exp. (%) Ag2644, Run 208393899 | Tissue Name | Rel. Exp. (%) Ag2644, Run 208393899 |
|---|---|---|---|
| AD 1 Hippo | 10.9 | Control (Path) 3 Temporal Ctx | 4.3 |
| AD 2 Hippo | 22.4 | Control (Path) 4 Temporal Ctx | 30.1 |
| AD 3 Hippo | 6.7 | AD 1 Occipital Ctx | 12.3 |
| AD 4 Hippo | 3.9 | AD 2 Occipital Ctx (Missing) | 60.7 |
| AD 5 hippo | 84.1 | AD 3 Occipital Ctx | 11.3 |
| AD 6 Hippo | 51.8 | AD 4 Occipital Ctx | 11.0 |
| Control 2 Hippo | 22.7 | AD 5 Occipital Ctx | 69.3 |
| Control 4 Hippo | 10.7 | AD 6 Occipital Ctx | 70.7 |
| Control (Path) 3 Hippo | 5.7 | Control 1 Occipital Ctx | 4.6 |
| AD 1 Temporal Ctx | 25.5 | Control 2 Occipital Ctx | 44.8 |
| AD 2 Temporal Ctx | 28.9 | Control 3 Occipital Ctx | 16.0 |
| AD 3 Temporal Ctx | 6.4 | Control 4 Occipital Ctx | 7.1 |
| AD 4 Temporal Ctx | 14.3 | Control (Path) 1 Occipital Ctx | 79.6 |
| AD 5 Inf Temporal Ctx | 100.0 | Control (Path) 2 Occipital Ctx | 14.5 |
| AD 5 SupTemporal Ctx | 72.7 | Control (Path) 3 Occipital Ctx | 0.0 |
| AD 6 Inf Temporal Ctx | 46.3 | Control (Path) 4 Occipital Ctx | 20.6 |
| AD 6 Sup Temporal Ctx | 66.9 | Control 1 Parietal Ctx | 4.9 |
| Control 1 Temporal Ctx | 10.8 | Control 2 Parietal Ctx | 69.7 |
| Control 2 Temporal Ctx | 50.0 | Control 3 Parietal Ctx | 17.3 |
| Control 3 Temporal Ctx | 15.9 | Control (Path) 1 Parietal Ctx | 62.4 |
| Control 4 Temporal Ctx | 8.8 | Control (Path) 2 Parietal Ctx | 31.0 |
| Control (Path) 1 Temporal Ctx | 63.3 | Control (Path) 3 Parietal Ctx | 0.0 |
| Control (Path) 2 Temporal Ctx | 20.4 | Control (Path) 4 Parietal Ctx | 54.3 |

TABLE ED

Panel 1.3D

| Tissue Name | Rel. Exp. (%) Ag-2575, Run 1624-30827 | Rel. Exp. (%) Ag-2575, Run 1624-31039 | Tissue Name | Rel. Exp. (%) Ag-2575, Run 1624-30827 | Rel. Exp. (%) Ag-2575, Run 1624-31039 |
|---|---|---|---|---|---|
| Liver adenocarcinoma | 0.4 | 0.4 | Kidney (fetal) | 6.0 | 6.0 |
| Pancreas | 0.4 | 0.4 | Renal ca. 786-0 | 13.5 | 13.5 |
| Pancreatic ca. CAPAN 2 | 4.0 | 4.0 | Renal ca. A498 | 11.2 | 11.2 |
| Adrenal gland | 1.5 | 1.5 | Renal ca. RXF 393 | 1.0 | 1.0 |
| Thyroid | 5.4 | 5.4 | Renal ca. ACHN | 2.9 | 2.9 |
| Salivary gland | 0.9 | 0.9 | Renal ca. UO-31 | 5.8 | 5.8 |
| Pituitary gland | 4.8 | 4.8 | Renal ca. TK-10 | 6.9 | 6.9 |

TABLE ED-continued

Panel 1.3D

| Tissue Name | Rel. Exp. (%) Ag-2575, Run 1624-30827 | Rel. Exp. (%) Ag-2575, Run 1624-31039 | Tissue Name | Rel. Exp. (%) Ag-2575, Run 1624-30827 | Rel. Exp. (%) Ag-2575, Run 1624-31039 |
|---|---|---|---|---|---|
| Brain (fetal) | 1.2 | 1.2 | Liver | 0.9 | 0.9 |
| Brain (whole) | 1.2 | 1.2 | Liver (fetal) | 3.7 | 3.7 |
| Brain (amygdala) | 3.1 | 3.1 | Liver ca. (hepatoblast) HepG2 | 10.0 | 10.0 |
| Brain (cerebellum) | 5.6 | 5.6 | Lung | 6.3 | 6.3 |
| Brain (hippocampus) | 5.4 | 5.4 | Lung (fetal) | 6.7 | 6.7 |
| Brain (substantia nigra) | 0.3 | 0.3 | Lung ca. (small cell) LX-1 | 0.0 | 0.0 |
| Brain (thalamus) | 1.7 | 1.7 | Lung ca. (small cell) NCI-H69 | 6.7 | 6.7 |
| Cerebral Cortex | 21.2 | 21.2 | Lung ca. (s.cell var.) SHP-77 | 21.2 | 21.2 |
| Spinal cord | 2.8 | 2.8 | Lung ca. (large cell)NCI-H460 | 4.4 | 4.4 |
| glio/astro U87-MG | 25.9 | 25.9 | Lung ca. (non-sm. cell) A549 | 2.7 | 2.7 |
| glio/astro U-118-MG | 9.5 | 9.5 | Lung ca. (non-s.cell) NCI-H23 | 3.0 | 3.0 |
| astrocytoma SW1783 | 17.4 | 17.4 | Lung ca. (non-s.cell) HOP-62 | 4.8 | 4.8 |
| neuro*; met SK-N-AS | 0.0 | 0.0 | Lung ca. (non-s.cl) NCI-H522 | 0.4 | 0.4 |
| astrocytoma SF-539 | 12.9 | 12.9 | Lung ca. (squam.) SW 900 | 3.4 | 3.4 |
| astrocytoma SNB-75 | 2.8 | 2.8 | Lung ca. (squam.) NCI-H596 | 2.7 | 2.7 |
| glioma SNB-19 | 27.0 | 27.0 | Mammary gland | 4.0 | 4.0 |
| glioma U251 | 4.6 | 4.6 | Breast ca.* (pl.ef) MCF-7 | 0.0 | 0.0 |
| glioma SF-295 | 5.2 | 5.2 | Breast ca.* (pl.ef) MDA-MB-231 | 7.5 | 7.5 |
| Heart (fetal) | 2.1 | 2.1 | Breast ca.* (pl.ef) T47D | 0.7 | 0.7 |
| Heart | 3.1 | 3.1 | Breast ca. BT-549 | 0.5 | 0.5 |
| Skeletal muscle (fetal) | 3.6 | 3.6 | Breast ca. MDA-N | 8.2 | 8.2 |
| Skeletal muscle | 0.0 | 0.0 | Ovary | 2.7 | 2.7 |
| Bone marrow | 0.8 | 0.8 | Ovarian ca. OVCAR-3 | 5.9 | 5.9 |
| Thymus | 6.8 | 6.8 | Ovarian ca. OVCAR-4 | 0.5 | 0.5 |
| Spleen | 1.6 | 1.6 | Ovarian ca. OVCAR-5 | 35.1 | 35.1 |
| Lymph node | 1.4 | 1.4 | Ovarian ca. OVCAR-8 | 12.8 | 12.8 |
| Colorectal | 5.7 | 5.7 | Ovarian ca. IGROV-1 | 0.0 | 0.0 |
| Stomach | 2.6 | 2.6 | Ovarian ca.* (ascites) SK-OV-3 | 2.0 | 2.0 |
| Small intestine | 8.8 | 8.8 | Uterus | 1.4 | 1.4 |
| Colon ca. SW480 | 0.0 | 0.0 | Placenta | 0.0 | 0.0 |
| Colon ca.* SW620(SW480 met) | 0.0 | 0.0 | Prostate | 0.8 | 0.8 |
| Colon ca. HT29 | 8.4 | 8.4 | Prostate ca.* (bone met)PC-3 | 7.0 | 7.0 |
| Colon ca. HCT-116 | 5.7 | 5.7 | Testis | 2.2 | 2.2 |
| Colon ca. CaCo-2 | 84.1 | 84.1 | Melanoma Hs688(A).T | 2.3 | 2.3 |
| Colon ca. tissue(ODO3866) | 40.3 | 40.3 | Melanoma* (met) Hs688(B).T | 2.8 | 2.8 |
| Colon ca. HCC-2998 | 14.7 | 14.7 | Melanoma UACC-62 | 1.5 | 1.5 |
| Gastric ca.* (liver met) NCI-N87 | 100.0 | 100.0 | Melanoma M14 | 4.3 | 4.3 |
| Bladder | 11.2 | 11.2 | Melanoma LOX IMVI | 7.6 | 7.6 |
| Trachea | 9.9 | 9.9 | Melanoma* (met) SK-MEL-5 | 13.0 | 13.0 |
| Kidney | 8.9 | 8.9 | Adipose | 11.0 | 11.0 |

TABLE EE

Panel 2D

| Tissue Name | Rel. Exp. (%) Ag-2644, Run 1624-23326 | Tissue Name | Rel. Exp. (%) Ag-2644, Run 1624-23326 |
|---|---|---|---|
| Normal Colon | 36.1 | Kidney Margin 8120608 | 2.9 |
| CC Well to Mod Diff (ODO3866) | 27.9 | Kidney Cancer 8120613 | 4.0 |
| CC Margin (ODO3866) | 11.1 | Kidney Margin 8120614 | 3.7 |
| CC Gr.2 rectosigmoid (ODO3868) | 19.1 | Kidney Cancer 9010320 | 10.2 |
| CC Margin (ODO3868) | 2.2 | Kidney Margin 9010321 | 8.0 |
| CC Mod Diff (ODO3920) | 21.0 | Normal Uterus | 0.0 |
| CC Margin (ODO3920) | 18.3 | Uterus Cancer 064011 | 12.2 |
| CC Gr.2 ascend colon (ODO3921) | 37.9 | Normal Thyroid | 12.8 |
| CC Margin (ODO3921) | 7.8 | Thyroid Cancer 064010 | 53.2 |
| CC from Partial Hepatectomy (ODO4309) Mets | 74.7 | Thyroid Cancer A302152 | 33.7 |
| Liver Margin (ODO4309) | 15.7 | Thyroid Margin A302153 | 13.6 |
| Colon mets to lung (OD04451-01) | 5.0 | Normal Breast | 27.7 |
| Lung Margin (OD04451-02) | 8.2 | Breast Cancer (OD04566) | 1.7 |
| Normal Prostate 6546-1 | 21.5 | Breast Cancer (OD04590-01) | 2.7 |

TABLE EE-continued

Panel 2D

| Tissue Name | Rel. Exp. (%) Ag-2644, Run 1624-23326 | Tissue Name | Rel. Exp. (%) Ag-2644, Run 1624-23326 |
|---|---|---|---|
| Prostate Cancer (OD04410) | 10.7 | Breast Cancer Mets (OD04590-03) | 2.8 |
| Prostate Margin (OD04410) | 4.0 | Breast Cancer Metastasis (OD04655-05) | 35.1 |
| Prostate Cancer (OD04720-01) | 8.7 | Breast Cancer 064006 | 13.2 |
| Prostate Margin (OD04720-02) | 12.1 | Breast Cancer 1024 | 7.0 |
| Normal Lung 061010 | 24.8 | Breast Cancer 9100266 | 2.9 |
| Lung Met to Muscle (ODO4286) | 15.4 | Breast Margin 9100265 | 4.8 |
| Muscle Margin (ODO4286) | 1.5 | Breast Cancer A209073 | 18.6 |
| Lung Malignant Cancer (OD03126) | 7.9 | Breast Margin A2090734 | 14.4 |
| Lung Margin (OD03126) | 22.4 | Normal Liver | 6.2 |
| Lung Cancer (OD04404) | 3.8 | Liver Cancer 064003 | 1.8 |
| Lung Margin (OD04404) | 10.6 | Liver Cancer 1025 | 3.4 |
| Lung Cancer (OD04565) | 2.2 | Liver Cancer 1026 | 3.6 |
| Lung Margin (OD04565) | 5.5 | Liver Cancer 6004-T | 4.8 |
| Lung Cancer (OD04237-01) | 14.7 | Liver Tissue 6004-N | 1.8 |
| Lung Margin (OD04237-02) | 18.0 | Liver Cancer 6005-T | 3.3 |
| Ocular Mel Met to Liver (ODO4310) | 1.0 | Liver Tissue 6005-N | 2.1 |
| Liver Margin (ODO4310) | 5.4 | Normal Bladder | 10.7 |
| Melanoma Mets to Lung (OD04321) | 4.3 | Bladder Cancer 1023 | 1.3 |
| Lung Margin (OD04321) | 18.7 | Bladder Cancer A302173 | 4.6 |
| Normal Kidney | 35.4 | Bladder Cancer (OD04718-01) | 7.2 |
| Kidney Ca, Nuclear grade 2 (OD04338) | 26.6 | Bladder Normal Adjacent (OD04718-03) | 10.2 |
| Kidney Margin (OD04338) | 14.6 | Normal Ovary | 2.0 |
| Kidney Ca Nuclear grade 1/2 (OD04339) | 23.7 | Ovarian Cancer 064008 | 23.3 |
| Kidney Margin (OD04339) | 30.4 | Ovarian Cancer (OD04768-07) | 48.3 |
| Kidney Ca, Clear cell type (OD04340) | 19.3 | Ovary Margin (OD04768-08) | 2.7 |
| Kidney Margin (OD04340) | 22.7 | Normal Stomach | 21.0 |
| Kidney Ca, Nuclear grade 3 (OD04348) | 1.4 | Gastric Cancer 9060358 | 3.8 |
| Kidney Margin (OD04348) | 20.3 | Stomach Margin 9060359 | 15.8 |
| Kidney Cancer (OD04622-01) | 13.9 | Gastric Cancer 9060395 | 17.0 |
| Kidney Margin (OD04622-03) | 2.7 | Stomach Margin 9060394 | 15.8 |
| Kidney Cancer (OD04450-01) | 16.6 | Gastric Cancer 9060397 | 49.0 |
| Kidney Margin (OD04450-03) | 17.8 | Stomach Margin 9060396 | 12.2 |
| Kidney Cancer 8120607 | 2.9 | Gastric Cancer 064005 | 100.0 |

TABLE EF

Panel 3D

| Tissue Name | Rel. Exp. (%) Ag-2644, Run 1648-86194 | Tissue Name | Rel. Exp. (%) Ag-2644, Run 1648-86194 |
|---|---|---|---|
| Daoy-Medulloblastoma | 5.5 | Ca Ski-Cervical epidermoid carcinoma (metastasis) | 16.5 |
| TE671-Medulloblastoma | 0.0 | ES-2-Ovarian clear cell carcinoma | 24.7 |
| D283 Med-Medulloblastoma | 15.3 | Ramos-Stimulated with PMA/ionomycin 6h | 0.0 |
| PFSK-1-Primitive Neuroectodermal | 1.6 | Ramos-Stimulated with PMA/ionomycin 14h | 2.2 |
| XF-498-CNS | 4.9 | MEG-01-Chronic myelogenous leukemia (megokaryoblast) | 30.8 |
| SNB-78-Glioma | 8.8 | Raji-Burkitt's lymphoma | 3.4 |
| SF-268-Glioblastoma | 1.7 | Daudi-Burkitt's lymphoma | 3.6 |
| T98G-Glioblastoma | 0.0 | U266-B-cell plasmacytoma | 5.9 |
| SK-N-SH-Neuroblastoma (metastasis) | 0.0 | CA46-Burkitt's lymphoma | 3.2 |
| SF-295-Glioblastoma | 10.3 | RL-non-Hodgkin's B-cell lymphoma | 0.0 |
| Cerebellum | 8.1 | JM1-pre-B-cell lymphoma | 0.0 |
| Cerebellum | 2.0 | Jurkat-T cell leukemia | 3.3 |
| NCI-H292-Mucoepidermoid lung carcinoma | 22.2 | TF-1-Erythroleukemia | 28.3 |
| DMS-114-Small cell lung cancer | 1.1 | HUT 78-T-cell lymphoma | 1.8 |
| DMS-79-Small cell lung cancer | 100.0 | U937-Histiocytic lymphoma | 4.4 |
| NCI-H146-Small cell lung cancer | 4.9 | KU-812-Myelogenous leukemia | 2.2 |
| NCI-H526-Small cell lung cancer | 6.9 | 769-P-Clear cell renal carcinoma | 3.8 |
| NCI-N417-Small cell lung cancer | 6.2 | Caki-2-Clear cell renal carcinoma | 1.8 |
| NCI-H82-Small cell lung cancer | 0.0 | SW 839-Clear cell renal carcinoma | 4.1 |
| NCI-H157-Squamous cell lung cancer (metastasis) | 30.6 | G401-Wilms' tumor | 0.0 |
| NCI-H1155-Large cell lung cancer | 14.9 | Hs766T-Pancreatic carcinoma (LN metastasis) | 26.2 |
| NCI-H1299-Large cell lung cancer | 33.9 | CAPAN-1-Pancreatic adenocarcinoma (liver metastasis) | 14.4 |
| NCI-H727-Lung carcinoid | 1.2 | SU86.86-Pancreatic carcinoma (liver metastasis) | 39.8 |
| NCI-UMC-11-Lung carcinoid | 4.1 | BxPC-3-Pancreatic adenocarcinoma | 3.3 |
| LX-1-Small cell lung cancer | 0.0 | HPAC-Pancreatic adenocarcinoma | 1.4 |
| Colo-205-Colon cancer | 1.4 | MIA PaCa-2-Pancreatic carcinoma | 2.1 |
| KM12-Colon cancer | 31.9 | CFPAC-1-Pancreatic ductal adenocarcinoma | 32.8 |
| KM20L2-Colon cancer | 15.1 | PANC-1-Pancreatic epithelioid ductal carcinoma | 22.4 |
| NCI-H716-Colon cancer | 17.1 | T24-Bladder carcinma (transitional cell) | 2.8 |
| SW-48-Colon adenocarcinoma | 28.5 | 5637-Bladder carcinoma | 11.4 |
| SW1116-Colon adenocarcinoma | 13.5 | HT-1197-Bladder carcinoma | 0.0 |

TABLE EF-continued

Panel 3D

| Tissue Name | Rel. Exp. (%) Ag-2644, Run 1648-86194 | Tissue Name | Rel. Exp. (%) Ag-2644, Run 1648-86194 |
|---|---|---|---|
| LS 174T-Colon adenocarcinoma | 56.3 | UM-UC-3-Bladder carcinma (transitional cell) | 1.9 |
| SW-948-Colon adenocarcinoma | 2.9 | A204-Rhabdomyo-sarcoma | 0.0 |
| SW-480-Colon adenocarcinoma | 10.9 | HT-1080-Fibrosarcoma | 4.5 |
| NCI-SNU-5-Gastric carcinoma | 0.0 | MG-63-Osteosarcoma | 2.2 |
| KATO III-Gastric carcinoma | 59.0 | SK-LMS-1-Leiomyo-sarcoma (vulva) | 13.3 |
| NCI-SNU-16-Gastric carcinoma | 29.5 | SJRH30-Rhabdomyo-sarcoma (met to bone marrow) | 5.6 |
| NCI-SNU-1-Gastric carcinoma | 15.8 | A431-Epidermoid carcinoma | 0.0 |
| RF-1-Gastric adenocarcinoma | 4.8 | WM266-4-Melanoma | 7.4 |
| RF-48-Gastric adenocarcinoma | 6.8 | DU 145-Prostate carcinoma (brain metastasis) | 0.0 |
| MKN-45-Gastric carcinoma | 1.8 | MDA-MB-468-Breast adenocarcinoma | 0.0 |
| NCI-N87-Gastric carcinoma | 24.7 | SCC-4-Squamous cell carcinoma of tongue | 0.0 |
| OVCAR-5-Ovarian carcinoma | 19.9 | SCC-9-Squamous cell carcinoma of tongue | 0.0 |
| RL95-2-Uterine carcinoma | 0.0 | SCC-15-Squamous cell carcinoma of tongue | 0.0 |
| HelaS3-Cervical adenocarcinoma | 0.0 | CAL 27-Squamous cell carcinoma of tongue | 4.0 |

TABLE EG

Panel 4D

| Tissue Name | Rel. Exp. (%) Ag-2644, Run 1586-64089 | Tissue Name | Rel. Exp. (%) Ag-2644, Run 1586-64089 |
|---|---|---|---|
| Secondary Th1 act | 0.5 | HUVEC IL-1beta | 3.3 |
| Secondary Th2 act | 0.4 | HUVEC IFN gamma | 14.4 |
| Secondary Tr1 act | 0.4 | HUVEC TNF alpha + IFN gamma | 27.7 |
| Secondary Th1 rest | 0.9 | HUVEC TNF alpha + IL4 | 12.2 |
| Secondary Th2 rest | 0.7 | HUVEC IL-11 | 1.0 |
| Secondary Tr1 rest | 0.9 | Lung Microvascular EC none | 1.1 |
| Primary Th1 act | 0.6 | Lung Microvascular EC TNFalpha + IL-1beta | 6.2 |
| Primary Th2 act | 1.6 | Microvascular Dermal EC none | 1.9 |
| Primary Tr1 act | 1.4 | Microsvasular Dermal EC TNFalpha + IL-1beta | 2.0 |
| Primary Th1 rest | 4.6 | Bronchial epithelium TNFalpha + IL1beta | 3.3 |
| Primary Th2 rest | 1.0 | Small airway epithelium none | 2.4 |
| Primary Tr1 rest | 1.8 | Small airway epithelium TNFalpha + IL-1beta | 33.9 |
| CD45RA CD4 lymphocyte act | 1.9 | Coronery artery SMC rest | 6.1 |
| CD45RO CD4 lymphocyte act | 2.4 | Coronery artery SMC TNFalpha + IL-1beta | 2.4 |
| CD8 lymphocyte act | 1.0 | Astrocytes rest | 3.9 |
| Secondary CD8 lymphocyte rest | 1.4 | Astrocytes TNFalpha + IL-1beta | 2.1 |
| Secondary CD8 lymphocyte act | 0.8 | KU-812 (Basophil) rest | 1.3 |
| CD4 lymphocyte none | 0.8 | KU-812 (Basophil) PMA/ionomycin | 17.8 |
| 2ry Th1/Th2/Tr1_anti-CD95 CH11 | 0.6 | CCD1106 (Keratino-cytes) none | 9.2 |
| LAK cells rest | 2.0 | CCD1106 (Keratino-cytes) TNFalpha + IL-1beta | 6.0 |
| LAK cells IL-2 | 5.4 | Liver cirrhosis | 2.1 |
| LAK cells IL-2 + IL-12 | 0.8 | Lupus kidney | 4.2 |
| LAK cells IL-2 + IFN gamma | 3.5 | NCI-H292 none | 35.8 |
| LAK cells IL-2 + IL-18 | 6.6 | NCI-H292 IL-4 | 52.9 |
| LAK cells PMA/ionomycin | 7.4 | NCI-H292 IL-9 | 45.1 |
| NK Cells IL-2 rest | 4.4 | NCI-H292 IL-13 | 25.7 |
| Two Way MLR 3 day | 3.4 | NCI-H292 IFN gamma | 42.9 |
| Two Way MLR 5 day | 1.4 | HPAEC none | 5.2 |
| Two Way MLR 7 day | 0.8 | HPAEC TNF alpha + IL-1 beta | 16.3 |
| PBMC rest | 2.6 | Lung fibroblast none | 6.3 |
| PBMC PWM | 14.5 | Lung fibroblast TNF alpha + IL-1 beta | 3.3 |
| PBMC PHA-L | 6.2 | Lung fibroblast IL-4 | 25.3 |
| Ramos (B cell) none | 4.9 | Lung fibroblast IL-9 | 7.6 |
| Ramos (B cell) ionomycin | 10.7 | Lung fibroblast IL-13 | 11.3 |
| B lymphocytes PWM | 9.1 | Lung fibroblast IFN gamma | 75.8 |
| B lymphocytes CD40L and IL-4 | 4.6 | Dermal fibroblast CCD1070 rest | 9.2 |
| EOL-1 dbcAMP | 0.0 | Dermal fibroblast CCD1070 TNF alpha | 11.0 |
| EOL-1 dbcAMP PMA/ionomycin | 1.5 | Dermal fibroblast CCD1070 IL-1 beta | 4.3 |
| Dendritic cells none | 1.4 | Dermal fibroblast IFN gamma | 17.8 |
| Dendritic cells LPS | 1.1 | Dermal fibroblast IL-4 | 10.0 |
| Dendritic cells anti-CD40 | 0.9 | IBD Colitis 2 | 2.5 |
| Monocytes rest | 5.3 | IBD Crohn's | 15.8 |
| Monocytes LPS | 10.5 | Colon | 100.0 |
| Macrophages rest | 0.9 | Lung | 14.1 |
| Macrophages LPS | 1.1 | Thymus | 55.5 |
| HUVEC none | 7.3 | Kidney | 17.6 |
| HUVEC starved | 4.2 | | |

CNS_neurodegeneration_v1.0 Summary: Ag2644 This panel does not show differential expression of the CG50365-01 gene in Alzheimer's disease. However, this expression profile confirms the presence of this gene in the brain. Please see Panel 1.3D for discussion of utility of this gene in the central nervous system.

Panel 1.3D Summary: Ag2575 The expression of the CG50365-01 gene was assessed in two independent runs on panel 1.3D with excellent concordance between runs. The expression of this gene appears to be highest in a sample derived from a gastric cancer cell line (NCI-H87)(CTs=31).

In addition, there is substantial expression in several colon cancer cell lines, ovarian cancer cell lines and brain cancer cell lines. Thus, the expression of this gene could be used to distinguish NCI-H87 cells from other samples in the panel. Moreover, therapeutic modulation of this gene, through the use of small molecule drugs, antibodies or protein therapeutics might be of benefit in the treatment of colon cancer, brain cancer or ovarian cancer.

In addition, this gene is expressed at low levels in the cerebral cortex. Carbonate dehydratase may play an important role in modulating excitatory synaptic transmission in brain. Therefore, this molecule may be of use in the treatment of schizophrenia, epilepsy, Alzheimer's disease, bipolar disorder, depression, or any clinical condition associated with impaired or altered neurotransmission.

REFERENCES

Parkkila S, Parkkila A K, Rajaniemi H, Shah G N, Grubb J H, Waheed A, Sly W S. Expression of membrane-associated carbonic anhydrase XIV on neurons and axons in mouse and human brain. Proc Natl Acad Sci USA 2001 Feb. 13; 98(4):1918–23

Although long suspected from histochemical evidence for carbonic anhydrase (CA) activity on neurons and observations that CA inhibitors enhance the extracellular alkaline shifts associated with synaptic transmission, an extracellular CA in brain had not been identified. A candidate for this CA was suggested by the recent discovery of membrane CA (CA XIV) whose mRNA is expressed in mouse and human brain and in several other tissues. For immunolocalization of CA XIV in mouse and human brain, we developed two antibodies, one against a secretory form of enzymatically active recombinant mouse CA XIV, and one against a synthetic peptide corresponding to the 24 C-terminal amino acids in the human enzyme. Immunostaining for CA XIV was found on neuronal membranes and axons in both mouse and human brain. The highest expression was seen on large neuronal bodies and axons in the anterolateral part of pons and medulla oblongata. Other CA XIV-positive sites included the hippocampus, corpus callosum, cerebellar white matter and peduncles, pyramidal tract, and choroid plexus. Mouse brain also showed a positive reaction in the molecular layer of the cerebral cortex and granular cellular layer of the cerebellum. These observations make CA XIV a likely candidate for the extracellular CA postulated to have an important role in modulating excitatory synaptic transmission in brain.

Panel 2D Summary: Ag2644 The expression of the CG50365-01 gene appears to be highest in a sample derived from a gastric cancer. In addition there is substantial expression associated with other gastric cancers, when compared to their adjacent normal tissues, as well as expression associated with ovarian cancer, breast cancer, thyroid cancer and colon cancer. This expression conforms with expression in Panel 1.3D. Thus, the expression of this gene could be used to used to distinguish this gastric cancer sample from other samples in the panel. Moreover, therapeutic modulation of this gene, through the use of small molecule drugs, antibodies or protein therapeutics might be of benefit in the treatment of colon cancer, breast cancer, ovarian cancer, gastric cancer or thyroid cancer.

Panel 3D Summary: Ag2644 The expression of the CG50365-01 gene appears to be highest in a sample derived from a lung cancer cell line (DMS-79). In addition there appears to be expression associated with a colon cancer cell line, a gastric cancer cell line and a pancreatic cancer cell line. Thus, the expression of this gene could be used to distinguish DMS-79 cells from other samples in the panel. Moreover, therapeutic modulation of this gene, through the use of small molecule drugs, antibodies or protein therapeutics might be of benefit in the treatment of colon cancer, pancreatic cancer, gastric cancer or lung cancer.

Panel 4D Summary: Ag2644 The CG50365-01 transcript is expressed in lung fibroblasts treated with gamma interferon, NCI-H292 cells regardless of treatment, activated basophil cell line, and gamma interferon treated HUVECs. It is also expressed in normal colon and thymus. The regulation of the transcript expression in fibroblasts and HUVECs suggests that the protein encoded by this transcript may be contribute to the inflammatory changes due to gamma interferon. Therefore, therapies designed with the protein encoded by this transcript could be important for the treatment of emphysema, psoriasis, arthritis and IBD.

Panel 5 Islet Summary: Ag2575 Expression of the CG50365-01 gene is low/undetectable in all samples on this panel (CTs>35).

NOV8a, NOV8b, and NOV8c: CG55794-01 and CG55794-03 and CG55794-06: Carboxypeptidase Expression of gene CG55794-01, variant CG55794-03, and splice variant CG55794-06 was assessed using the primer-probe sets Ag2622, Ag3953 and Ag6049, described in Tables FA, FB and FC. Results of the RTQ-PCR runs are shown in Tables FD, FE, FF, FG, FH, FI, FJ and FK. Please note that the probe/primer set Ag6049 matches only the CG55794-06 variant. This does not change the results presented below.

TABLE FA

Probe Name Ag2622

| Primers | Sequences | Length | Start Position |
|---|---|---|---|
| Forward | 5'-catcagggtcttcaagagattg-3' (SEQ ID NO:359) | 22 | 706 |
| Probe | TET-5'-ccgagacattgggattcccttctcat-3'-TAMRA (SEQ ID NO:360) | 26 | 731 |
| Reverse | 5'-acaaacccatatgttccactgt-3' (SEQ ID NO:361) | 22 | 775 |

TABLE FB

Probe Name Ag3953

| Primers | Sequences | Length | Start Position |
|---|---|---|---|
| Forward | 5'-acagtggaacatatgggtttgt-3' (SEQ ID NO:362) | 22 | 775 |
| Probe | TET-5'-agaagctcagatccagcccacctgt-3'-TAMRA (SEQ ID NO:363) | 25 | 803 |
| Reverse | 5'-catacacatcatccaggactga-3' (SEQ ID NO:364) | 22 | 852 |

TABLE FC

Probe Name Ag6049

| Primers | Sequences | Length | Start Position |
|---|---|---|---|
| Forward | 5'-gcttcttggtgtaattcaagttg-3' (SEQ ID NO:365) | 23 | 602 |
| Probe | TET-5'-acagaaggcagcaaatgcattgaaag-3'-TAMRA (SEQ ID NO:366) | 26 | 626 |
| Reverse | 5'-ccaactctataattggttccatactt-3' (SEQ ID NO:367) | 26 | 654 |

TABLE FD

CNS_neurodegeneration_v1.0

| Tissue Name | Rel. Exp. (%) Ag2622, Run 206942830 | Tissue Name | Rel. Exp. (%) Ag2622, Run 206942830 |
|---|---|---|---|
| AD 1 Hippo | 8.6 | Control (Path) 3 Temporal Ctx | 9.0 |
| AD 2 Hippo | 31.2 | Control (Path) 4 Temporal Ctx | 54.0 |
| AD 3 Hippo | 18.2 | AD 1 Occipital Ctx | 18.0 |
| AD 4 Hippo | 5.4 | AD 2 Occipital Ctx (Missing) | 0.0 |
| AD 5 hippo | 63.3 | AD 3 Occipital Ctx | 7.0 |
| AD 6 Hippo | 27.0 | AD 4 Occipital Ctx | 21.6 |
| Control 2 Hippo | 35.6 | AD 5 Occipital Ctx | 15.3 |
| Control 4 Hippo | 17.7 | AD 6 Occipital Ctx | 51.1 |
| Control (Path) 3 Hippo | 9.2 | Control 1 Occipital Ctx | 0.0 |
| AD 1 Temporal Ctx | 13.8 | Control 2 Occipital Ctx | 33.7 |
| AD 2 Temporal Ctx | 53.6 | Control 3 Occipital Ctx | 24.5 |
| AD 3 Temporal Ctx | 4.5 | Control 4 Occipital Ctx | 9.0 |
| AD 4 Temporal Ctx | 24.1 | Control (Path) 1 Occipital Ctx | 87.1 |
| AD 5 Inf Temporal Ctx | 84.7 | Control (Path) 2 Occipital Ctx | 10.2 |
| AD 5 SupTemporal Ctx | 28.1 | Control (Path) 3 Occipital Ctx | 9.3 |
| AD 6 Inf Temporal Ctx | 70.2 | Control (Path) 4 Occipital Ctx | 18.4 |
| AD 6 Sup Temporal Ctx | 100.0 | Control 1 Parietal Ctx | 2.3 |
| Control 1 Temporal Ctx | 2.9 | Control 2 Parietal Ctx | 58.2 |
| Control 2 Temporal Ctx | 13.6 | Control 3 Parietal Ctx | 10.9 |
| Control 3 Temporal Ctx | 8.7 | Control (Path) 1 Parietal Ctx | 65.5 |
| Control 4 Temporal Ctx | 19.5 | Control (Path) 2 Parietal Ctx | 17.1 |
| Control (Path) 1 Temporal Ctx | 47.0 | Control (Path) 3 Parietal Ctx | 3.6 |
| Control (Path) 2 Temporal Ctx | 54.3 | Control (Path) 4 Parietal Ctx | 27.5 |

TABLE FE

General_screening_panel_v1.4

| Tissue Name | Rel. Exp. (%) Ag3953, Run 2138-56130 | Tissue Name | Rel. Exp. (%) Ag3953, Run 2138-56130 |
|---|---|---|---|
| Adipose | 9.3 | Renal ca. TK-10 | 24.3 |
| Melanoma* Hs688(A).T | 0.0 | Bladder | 13.6 |
| Melanoma* Hs688(B).T | 11.1 | Gastric ca. (liver met.) NCI-N87 | 39.5 |
| Melanoma* M14 | 0.0 | Gastric ca. KATO III | 0.0 |
| Melanoma* LOXIMVI | 6.4 | Colon ca. SW-948 | 8.5 |
| Melanoma* SK-MEL-5 | 0.0 | Colon ca. SW480 | 0.0 |
| Squamous cell carcinoma SCC-4 | 4.1 | Colon ca.* (SW480 met) SW620 | 0.0 |
| Testis Pool | 3.0 | Colon ca. HT29 | 0.0 |
| Prostate ca.* (bone met) PC-3 | 0.0 | Colon ca. HCT-116 | 40.6 |
| Prostate Pool | 18.4 | Colon ca. CaCo-2 | 0.0 |
| Placenta | 0.0 | Colon cancer tissue | 0.0 |
| Uterus Pool | 5.8 | Colon ca. SW1116 | 5.2 |
| Ovarian ca. OVCAR-3 | 0.0 | Colon ca. Colo-205 | 0.0 |
| Ovarian ca. SK-OV-3 | 100.0 | Colon ca. SW-48 | 0.0 |
| Ovarian ca. OVCAR-4 | 0.0 | Colon Pool | 21.3 |
| Ovarian ca. OVCAR-5 | 25.5 | Small Intestine Pool | 13.8 |
| Ovarian ca. IGROV-1 | 0.0 | Stomach Pool | 8.0 |
| Ovarian ca. OVCAR-8 | 0.0 | Bone Marrow Pool | 2.6 |
| Ovary | 16.0 | Fetal Heart | 0.0 |
| Breast ca. MCF-7 | 8.5 | Heart Pool | 1.7 |
| Breast ca. MDA-MB-231 | 3.7 | Lymph Node Pool | 14.2 |
| Breast ca. BT 549 | 4.8 | Fetal Skeletal Muscle | 0.0 |
| Breast ca. T47D | 26.1 | Skeletal Muscle Pool | 31.0 |
| Breast ca. MDA-N | 0.0 | Spleen Pool | 7.9 |
| Breast Pool | 7.2 | Thymus Pool | 12.2 |
| Trachea | 0.0 | CNS cancer (glio/astro) U87-MG | 0.0 |
| Lung | 18.6 | CNS cancer (glio/astro) U-118-MG | 5.9 |
| Fetal Lung | 3.3 | CNS cancer (neuro;met) SK-N-AS | 6.2 |
| Lung ca. NCI-N417 | 5.4 | CNS cancer (astro) SF-539 | 4.8 |
| Lung ca. LX-1 | 0.0 | CNS cancer (astro) SNB-75 | 39.2 |
| Lung ca. NCI-H146 | 4.1 | CNS cancer (glio) SNB-19 | 9.5 |
| Lung ca. SHP-77 | 11.3 | CNS cancer (glio) SF-295 | 3.6 |
| Lung ca. A549 | 0.0 | Brain (Amygdala) Pool | 53.6 |
| Lung ca. NCI-H526 | 4.2 | Brain (cerebellum) | 0.0 |
| Lung ca. NCI-H23 | 13.4 | Brain (fetal) | 15.9 |
| Lung ca. NCI-H460 | 10.3 | Brain (Hippocampus) Pool | 25.5 |
| Lung ca. HOP-62 | 6.7 | Cerebral Cortex Pool | 47.3 |
| Lung ca. NCI-H522 | 26.6 | Brain (*Substantia nigra*) Pool | 42.6 |
| Liver | 0.0 | Brain (Thalamus) Pool | 58.2 |
| Fetal Liver | 4.7 | Brain (whole) | 9.5 |
| Liver ca. HepG2 | 0.0 | Spinal Cord Pool | 46.0 |
| Kidney Pool | 40.1 | Adrenal Gland | 0.0 |
| Fetal Kidney | 17.1 | Pituitary gland Pool | 12.9 |
| Renal ca. 786-0 | 12.2 | Salivary Gland | 3.3 |
| Renal ca. A498 | 6.7 | Thyroid (female) | 11.5 |
| Renal ca. ACHN | 0.0 | Pancreatic ca. CAPAN2 | 0.0 |
| Renal ca. UO-31 | 3.1 | Pancreas Pool | 26.6 |

TABLE FF

Panel 1.3D

| Tissue Name | Rel. Exp. (%) Ag-2622, Run 1625-54681 | Rel. Exp. (%) Ag-2622, Run 1656-72349 | Tissue Name | Rel. Exp. (%) Ag-2622, Run 1625-54681 | Rel. Exp. (%) Ag-2622, Run 1656-72349 |
|---|---|---|---|---|---|
| Liver adenocarcinoma | 0.0 | 0.0 | Kidney (fetal) | 10.5 | 0.0 |
| Pancreas | 0.0 | 0.0 | Renal ca. 786-0 | 0.0 | 0.0 |
| Pancreatic ca. CAPAN 2 | 0.0 | 10.3 | Renal ca. A498 | 7.0 | 22.2 |
| Adrenal gland | 7.4 | 33.7 | Renal ca. RXF 393 | 0.0 | 8.5 |
| Thyroid | 46.7 | 7.7 | Renal ca. ACHN | 0.0 | 0.0 |
| Salivary gland | 0.0 | 21.2 | Renal ca. UO-31 | 0.0 | 0.0 |
| Pituitary gland | 14.8 | 40.9 | Renal ca. TK-10 | 0.0 | 0.0 |
| Brain (fetal) | 13.8 | 0.0 | Liver | 0.0 | 0.0 |
| Brain (whole) | 60.3 | 75.3 | Liver (fetal) | 6.8 | 0.0 |
| Brain (amygdala) | 61.6 | 28.9 | Liver ca. (hepatoblast) HepG2 | 0.0 | 0.0 |
| Brain (cerebellum) | 6.2 | 0.0 | Lung | 19.8 | 10.8 |
| Brain (hippocampus) | 47.3 | 97.9 | Lung (fetal) | 23.2 | 48.6 |
| Brain (substantia nigra) | 28.5 | 82.9 | Lung ca. (small cell) LX-1 | 0.0 | 0.0 |
| Brain (thalamus) | 54.0 | 100.0 | Lung ca. (small cell) NCI-H69 | 0.0 | 0.0 |
| Cerebral Cortex | 0.0 | 27.7 | Lung ca. (s.cell var.) SHP-77 | 0.0 | 0.0 |
| Spinal cord | 77.4 | 28.7 | Lung ca. (large cell)NCI-H460 | 0.0 | 0.0 |
| glio/astro U87-MG | 0.0 | 0.0 | Lung ca. (non-sm. cell) A549 | 0.0 | 0.0 |
| glio/astro U-118-MG | 6.5 | 10.7 | Lung ca. (non-s.cell) NCI-H23 | 0.0 | 23.7 |
| astrocytoma SW1783 | 8.3 | 0.0 | Lung ca. (non-s.cell) HOP-62 | 0.0 | 10.2 |
| neuro*;met SK-N-AS | 0.0 | 0.0 | Lung ca. (non-s.cl) NCI-H522 | 0.0 | 14.8 |
| astrocytoma SF-539 | 0.0 | 0.0 | Lung ca. (squam.) SW 900 | 0.0 | 26.4 |
| astrocytoma SNB-75 | 7.6 | 19.8 | Lung ca. (squam.) NCI-H596 | 0.0 | 0.0 |
| glioma SNB-19 | 13.2 | 14.4 | Mammary gland | 13.0 | 0.0 |
| glioma U251 | 7.5 | 0.0 | Breast ca.* (pl.ef) MCF-7 | 0.0 | 0.0 |
| glioma SF-295 | 0.0 | 0.0 | Breast ca.* (pl.ef) MDA-231 | 0.0 | 0.0 |
| Heart (fetal) | 0.0 | 0.0 | Breast ca.* (pl.ef) T47D | 0.0 | 0.0 |
| Heart | 0.0 | 0.0 | Breast ca. BT-549 | 2.6 | 27.2 |
| Skeletal muscle (fetal) | 7.1 | 11.3 | Breast ca. MDA-N | 0.0 | 0.0 |
| Skeletal muscle | 84.7 | 57.0 | Ovary | 24.1 | 0.0 |
| Bone marrow | 0.0 | 0.0 | Ovarian ca. OVCAR-3 | 0.0 | 5.8 |
| Thymus | 19.6 | 0.0 | Ovarian ca. OVCAR-4 | 0.0 | 0.0 |
| Spleen | 0.0 | 13.2 | Ovarian ca. OVCAR-5 | 0.0 | 0.0 |
| Lymph node | 0.0 | 0.0 | Ovarian ca. OVCAR-8 | 0.0 | 0.0 |
| Colorectal | 5.8 | 28.3 | Ovarian ca. IGROV-1 | 0.0 | 0.0 |
| Stomach | 0.0 | 0.0 | Ovarian ca.* (ascites) SK-OV-3 | 11.3 | 62.9 |
| Small intestine | 7.6 | 24.5 | Uterus | 0.0 | 33.9 |
| Colon ca. SW480 | 0.0 | 0.0 | Placenta | 0.0 | 0.0 |
| Colon ca.* SW620(SW480 met) | 0.0 | 10.2 | Prostate | 13.3 | 0.0 |
| Colon ca. HT29 | 0.0 | 0.0 | Prostate ca.* (bone met)PC-3 | 0.0 | 0.0 |
| Colon ca. HCT-116 | 19.9 | 0.0 | Testis | 22.2 | 23.0 |
| Colon ca. CaCo-2 | 0.0 | 0.0 | Melanoma Hs688(A).T | 0.0 | 0.0 |
| Colon ca. tissue(ODO3866) | 16.8 | 9.0 | Melanoma* (met) Hs688(B).T | 0.0 | 0.0 |
| Colon ca. HCC-2998 | 12.5 | 0.0 | Melanoma UACC-62 | 0.0 | 0.0 |
| Gastric ca.* (liver met) NCI-N87 | 27.0 | 13.3 | Melanoma M14 | 0.0 | 0.0 |
| Bladder | 28.9 | 12.4 | Melanoma LOX IMVI | 0.0 | 0.0 |
| Trachea | 13.6 | 0.0 | Melanoma* (met) SK-MEL-5 | 0.0 | 0.0 |
| Kidney | 100.0 | 28.5 | Adipose | 14.0 | 9.7 |

TABLE FG

Panel 2D

| Tissue Name | Rel. Exp. (%) Ag-2622, Run 1635-78215 | Rel. Exp. (%) Ag-2622, Run 1659-10584 | Tissue Name | Rel. Exp. (%) Ag-2622, Run 1635-78215 | Rel. Exp. (%) Ag-2622, Run 1659-10584 |
|---|---|---|---|---|---|
| Normal Colon | 7.3 | 20.4 | Kidney Margin 8120608 | 0.8 | 0.0 |
| CC Well to Mod Diff (ODO3866) | 0.4 | 0.0 | Kidney Cancer 8120613 | 0.0 | 1.4 |
| CC Margin (ODO3866) | 2.7 | 2.7 | Kidney Margin 8120614 | 1.6 | 3.3 |
| CC Gr.2 rectosigmoid (ODO3868) | 3.3 | 0.0 | Kidney Cancer 9010320 | 0.9 | 1.9 |
| CC Margin (ODO3868) | 0.5 | 6.6 | Kidney Margin 9010321 | 5.2 | 12.4 |
| CC Mod Diff (ODO3920) | 0.0 | 0.0 | Normal Uterus | 0.5 | 0.0 |
| CC Margin (ODO3920) | 3.4 | 10.4 | Uterus Cancer 064011 | 4.6 | 9.4 |
| CC Gr.2 ascend colon (ODO3921) | 2.8 | 4.7 | Normal Thyroid | 8.2 | 9.7 |

TABLE FG-continued

Panel 2D

| Tissue Name | Rel. Exp. (%) Ag-2622, Run 1635-78215 | Rel. Exp. (%) Ag-2622, Run 1659-10584 | Tissue Name | Rel. Exp. (%) Ag-2622, Run 1635-78215 | Rel. Exp. (%) Ag-2622, Run 1659-10584 |
|---|---|---|---|---|---|
| CC Margin (ODO3921) | 1.9 | 5.5 | Thyroid Cancer 064010 | 1.2 | 10.2 |
| CC from Partial Hepatectomy (ODO4309) Mets | 1.2 | 2.0 | Thyroid Cancer A302152 | 2.8 | 2.1 |
| Liver Margin (ODO4309) | 1.0 | 4.5 | Thyroid Margin A302153 | 7.4 | 19.2 |
| Colon mets to lung (OD04451-01) | 0.0 | 0.0 | Normal Breast | 1.9 | 4.7 |
| Lung Margin (OD04451-02) | 0.7 | 1.8 | Breast Cancer (OD04566) | 4.7 | 6.1 |
| Normal Prostate 6546-1 | 30.4 | 27.7 | Breast Cancer (OD04590-01) | 1.3 | 5.2 |
| Prostate Cancer (OD04410) | 7.9 | 15.9 | Breast Cancer Mets (OD04590-03) | 100.0 | 4.0 |
| Prostate Margin (OD04410) | 13.9 | 47.3 | Breast Cancer Metastasis (OD04655-05) | 17.3 | 33.9 |
| Prostate Cancer (OD04720-01) | 5.5 | 8.7 | Breast Cancer 064006 | 16.6 | 14.3 |
| Prostate Margin (OD04720-02) | 9.2 | 37.6 | Breast Cancer 1024 | 8.2 | 39.8 |
| Normal Lung 061010 | 4.6 | 5.3 | Breast Cancer 9100266 | 1.0 | 2.4 |
| Lung Met to Muscle (ODO4286) | 0.7 | 2.6 | Breast Margin 9100265 | 0.5 | 2.0 |
| Muscle Margin (ODO4286) | 5.3 | 19.6 | Breast Cancer A209073 | 0.0 | 17.0 |
| Lung Malignant Cancer (OD03126) | 2.4 | 3.7 | Breast Margin A2090734 | 2.3 | 5.3 |
| Lung Margin (OD03126) | 4.6 | 7.2 | Normal Liver | 3.1 | 9.3 |
| Lung Cancer (OD04404) | 1.2 | 1.7 | Liver Cancer 064003 | 0.3 | 0.0 |
| Lung Margin (OD04404) | 1.5 | 3.6 | Liver Cancer 1025 | 0.8 | 0.0 |
| Lung Cancer (OD04565) | 0.0 | 0.0 | Liver Cancer 1026 | 0.0 | 0.0 |
| Lung Margin (OD04565) | 0.0 | 1.5 | Liver Cancer 6004-T | 0.4 | 4.6 |
| Lung Cancer (OD04237-01) | 3.9 | 17.4 | Liver Tissue 6004-N | 0.0 | 0.0 |
| Lung Margin (OD04237-02) | 0.6 | 6.5 | Liver Cancer 6005-T | 0.5 | 0.0 |
| Ocular Mel Met to Liver (ODO4310) | 0.0 | 2.4 | Liver Tissue 6005-N | 0.0 | 0.0 |
| Liver Margin (ODO4310) | 1.4 | 1.3 | Normal Bladder | 2.0 | 10.0 |
| Melanoma Mets to Lung (OD04321) | 1.0 | 2.5 | Bladder Cancer 1023 | 0.6 | 0.0 |
| Lung Margin (OD04321) | 0.9 | 8.5 | Bladder Cancer A302173 | 6.9 | 9.0 |
| Normal Kidney | 34.4 | 100.0 | Bladder Cancer (OD04718-01) | 1.0 | 1.7 |
| Kidney Ca, Nuclear grade 2 (OD04338) | 4.8 | 16.5 | Bladder Normal Adjacent (OD04718-03) | 3.1 | 10.2 |
| Kidney Margin (OD04338) | 3.9 | 27.4 | Normal Ovary | 1.6 | 4.2 |
| Kidney Ca Nuclear grade 1/2 (OD04339) | 10.8 | 26.4 | Ovarian Cancer 064008 | 2.2 | 8.3 |
| Kidney Margin (OD04339) | 21.8 | 55.1 | Ovarian Cancer (OD04768-07) | 0.0 | 0.0 |
| Kidney Ca, Clear cell type (OD04340) | 0.8 | 1.8 | Ovary Margin (OD04768-08) | 0.0 | 3.2 |
| Kidney Margin (OD04340) | 11.8 | 41.2 | Normal Stomach | 2.1 | 0.0 |
| Kidney Ca, Nuclear grade 3 (OD04348) | 0.0 | 0.0 | Gastric Cancer 9060358 | 0.0 | 0.0 |
| Kidney Margin (OD04348) | 17.9 | 28.3 | Stomach Margin 9060359 | 0.0 | 4.5 |
| Kidney Cancer (OD04622-01) | 1.9 | 2.3 | Gastric Cancer 9060395 | 2.0 | 0.0 |
| Kidney Margin (OD04622-03) | 4.6 | 2.4 | Stomach Margin 9060394 | 3.4 | 10.8 |
| Kidney Cancer (OD04450-01) | 2.1 | 6.5 | Gastric Cancer 9060397 | 1.3 | 0.0 |
| Kidney Margin (OD04450-03) | 16.5 | 47.3 | Stomach Margin 9060396 | 0.0 | 2.7 |
| Kidney Cancer 8120607 | 0.6 | 0.0 | Gastric Cancer 064005 | 1.8 | 13.6 |

TABLE FH

Panel 4D

| Tissue Name | Rel. Exp. (%) Ag2622, Run 162554700 | Rel. Exp. (%) Ag2622, Run 165806297 |
|---|---|---|
| Secondary Th1 act | 0.0 | 0.1 |
| Secondary Th2 act | 0.1 | 0.0 |
| Secondary Tr1 act | 0.0 | 0.0 |
| Secondary Th1 rest | 0.0 | 0.0 |
| Secondary Th2 rest | 0.0 | 0.0 |
| Secondary Tr1 rest | 0.0 | 0.0 |
| Primary Th1 act | 0.0 | 0.0 |
| Primary Th2 act | 0.2 | 0.0 |
| Primary Tr1 act | 0.0 | 0.0 |
| Primary Th1 rest | 0.0 | 0.0 |
| Primary Th2 rest | 0.1 | 0.0 |
| Primary Tr1 rest | 0.2 | 0.0 |
| CD45RA CD4 lymphocyte act | 0.0 | 0.0 |
| CD45RO CD4 lymphocyte act | 0.1 | 0.1 |
| CD8 lymphocyte act | 0.0 | 0.0 |
| Secondary CD8 lymphocyte rest | 0.0 | 0.0 |
| Secondary CD8 lymphocyte act | 0.0 | 0.0 |
| CD4 lymphocyte none | 0.2 | 0.0 |
| 2ry Th1/Th2/Tr1_anti-CD95 CH11 | 0.0 | 0.0 |
| LAK cells rest | 0.0 | 0.0 |
| LAK cells IL-2 | 0.0 | 0.0 |
| LAK cells IL-2 + IL-12 | 0.0 | 0.0 |
| LAK cells IL-2 + IFN gamma | 0.1 | 0.1 |
| LAK cells IL-2 + IL-18 | 0.1 | 0.0 |
| LAK cells PMA/ionomycin | 0.0 | 0.0 |
| NK Cells IL-2 rest | 0.1 | 0.0 |
| Two Way MLR 3 day | 0.0 | 0.0 |
| Two Way MLR 5 day | 0.0 | 0.0 |
| Two Way MLR 7 day | 0.0 | 0.0 |
| PBMC rest | 0.0 | 0.0 |
| PBMC PWM | 0.3 | 0.1 |

TABLE FH-continued

Panel 4D

| Tissue Name | Rel. Exp. (%) Ag2622, Run 162554700 | Rel. Exp. (%) Ag2622, Run 165806297 |
|---|---|---|
| PBMC PHA-L | 0.1 | 0.0 |
| Ramos (B cell) none | 0.0 | 0.0 |
| Ramos (B cell) ionomycin | 0.0 | 0.0 |
| B lymphocytes PWM | 0.1 | 0.0 |
| B lymphocytes CD40L and IL-4 | 0.0 | 0.0 |
| EOL-1 dbcAMP | 0.0 | 0.0 |
| EOL-1 dbcAMP PMA/ionomycin | 0.2 | 0.1 |
| Dendritic cells none | 0.0 | 0.0 |
| Dendritic cells LPS | 0.0 | 0.1 |
| Dendritic cells anti-CD40 | 0.0 | 0.0 |
| Monocytes rest | 0.0 | 0.0 |
| Monocytes LPS | 0.0 | 0.0 |
| Macrophages rest | 0.0 | 0.0 |
| Macrophages LPS | 0.0 | 0.0 |
| HUVEC none | 0.0 | 0.0 |
| HUVEC starved | 0.0 | 0.0 |
| HUVEC IL-1 beta | 0.0 | 0.0 |
| HUVEC IFN gamma | 0.3 | 0.0 |
| HUVEC TNF alpha + IFN gamma | 0.0 | 0.0 |
| HUVEC TNF alpha + IL4 | 0.0 | 0.0 |
| HUVEC IL-11 | 0.0 | 0.0 |
| Lung Microvascular EC none | 0.4 | 0.1 |
| Lung Microvascular EC TNF alpha + IL-1 beta | 0.0 | 0.0 |
| Microvascular Dermal EC none | 0.0 | 0.0 |
| Microvasular Dermal EC TNF alpha + IL-1 beta | 0.1 | 0.0 |
| Bronchial epithelium TNF alpha + IL1 beta | 0.0 | 0.1 |
| Small airway epithelium none | 0.0 | 0.1 |
| Small airway epithelium TNF alpha + IL-1 beta | 1.1 | 0.4 |
| Coronery artery SMC rest | 0.0 | 0.0 |
| Coronery artery SMC TNF alpha + IL-1 beta | 0.0 | 0.0 |
| Astrocytes rest | 0.0 | 0.0 |
| Astrocytes TNF alpha + IL-1 beta | 0.2 | 0.2 |
| KU-812 (Basophil) rest | 0.0 | 0.0 |
| KU-812 (Basophil) PMA/ionomycin | 0.1 | 0.0 |
| CCD1106 (Keratinocytes) none | 0.0 | 0.0 |
| CCD1106 (Keratinocytes) TNF alpha + IL-1 beta | 0.0 | 0.1 |
| Liver cirrhosis | 0.8 | 0.6 |
| Lupus kidney | 0.2 | 0.4 |
| NCI-H292 none | 0.0 | 0.0 |
| NCI-H292 IL-4 | 0.0 | 0.0 |
| NCI-H292 IL-9 | 0.0 | 0.1 |
| NCI-H292 IL-13 | 0.0 | 0.0 |
| NCI-H292 IFN gamma | 0.1 | 0.0 |
| HPAEC none | 0.1 | 0.0 |
| HPAEC TNF alpha + IL-1 beta | 0.0 | 0.0 |
| Lung fibroblast none | 0.1 | 0.0 |
| Lung fibroblast TNF alpha + IL-1 beta | 0.1 | 0.0 |
| Lung fibroblast IL-4 | 0.0 | 0.1 |
| Lung fibroblast IL-9 | 0.4 | 0.1 |
| Lung fibroblast IL-13 | 0.1 | 0.0 |
| Lung fibroblast IFN gamma | 0.5 | 0.1 |
| Dermal fibroblast CCD1070 rest | 0.1 | 0.1 |
| Dermal fibroblast CCD1070 TNF alpha | 0.0 | 0.0 |
| Dermal fibroblast CCD1070 IL-1 beta | 0.0 | 0.0 |
| Dermal fibroblast IFN gamma | 0.1 | 0.0 |
| Dermal fibroblast IL-4 | 0.0 | 0.1 |
| IBD Colitis 2 | 0.0 | 0.0 |
| IBD Crohn's | 1.0 | 2.2 |
| Colon | 100.0 | 100.0 |
| Lung | 0.2 | 0.0 |
| Thymus | 1.3 | 0.9 |
| Kidney | 0.5 | 0.0 |

TABLE FI

Panel 5 Islet

| Tissue Name | Rel. Exp. (%) Ag3953, Run 223846464 |
|---|---|
| 97457_Patient-02go_adipose | 0.0 |
| 97476_Patient-07sk_skeletal muscle | 0.0 |
| 97477_Patient-07ut_uterus | 0.0 |
| 97478_Patient-07pl_placenta | 0.0 |
| 99167_Bayer Patient 1 | 0.0 |
| 97482_Patient-08ut_uterus | 0.0 |
| 97483 Patient-08pl_placenta | 3.7 |
| 97486_Patient-09sk_skeletal muscle | 0.0 |
| 97487_Patient-09ut_uterus | 3.8 |
| 97488_Patient-09pl_placenta | 0.0 |
| 97492_Patient-10ut_uterus | 0.0 |
| 97493_Patient-10pl_placenta | 0.0 |
| 97495_Patient-11go_adipose | 0.0 |
| 97496_Patient-11sk_skeletal muscle | 3.3 |
| 97497_Patient-11ut_uterus | 0.0 |
| 97498_Patient-11pl_placenta | 4.0 |
| 97500_Patient-12go_adipose | 4.2 |
| 97501_Patient-12sk_skeletal muscle | 3.5 |
| 97502_Patient-12ut_uterus | 0.0 |
| 97503_Patient-12pl_placenta | 0.0 |
| 94721_Donor 2 U - A_Mesenchymal Stem Cells | 0.0 |
| 94722_Donor 2 U - B_Mesenchymal Stem Cells | 4.0 |
| 94723_Donor 2 U - C_Mesenchymal Stem Cells | 0.0 |
| 94709_Donor 2 AM - A_adipose | 0.0 |
| 94710_Donor 2 AM - B_adipose | 0.0 |
| 94711_Donor 2 AM - C_adipose | 0.0 |
| 94712_Donor 2 AD - A_adipose | 0.0 |
| 94713_Donor 2 AD - B_adipose | 0.0 |
| 94714_Donor 2 AD - C_adipose | 0.0 |
| 94742_Donor 3 U - A_Mesenchymal Stem Cells | 0.0 |
| 94743_Donor 3 U - B_Mesenchymal Stem Cells | 0.0 |
| 94730_Donor 3 AM - A_adipose | 4.4 |
| 94731_Donor 3 AM - B_adipose | 0.0 |
| 94732_Donor 3 AM - C_adipose | 0.0 |
| 94733_Donor 3 AD - A_adipose | 0.0 |
| 94734_Donor 3 AD - B_adipose | 0.0 |
| 94735_Donor 3 AD - C_adipose | 3.6 |
| 77138_Liver_HepG2untreated | 0.0 |
| 73556_Heart_Cardiac stromal cells (primary) | 0.0 |
| 81735_Small Intestine | 100.0 |
| 72409_Kidney_Proximal Convoluted Tubule | 0.0 |
| 82685_Small intestine_Duodenum | 0.0 |
| 90650_Adrenal_Adrenocortical adenoma | 0.0 |
| 72410_Kidney_HRCE | 0.0 |
| 72411_Kidney_HRE | 0.0 |
| 73139_Uterus_Uterine smooth muscle cells | 0.0 |

CNS_neurodegeneration_v1.0 Summary: Ag2622 This panel confirms the expression of the CG55794-01 gene in the CNS; See panel 1.3d for a discussion of utility. Ag6049 Results from one experiment with the CG55794-06 gene are not included. The amp plot indicates that there were experimental difficulties with this run.

General_screening_panel_v1.4 Summary: Ag3953 Highest expression of the CG55794-01 gene is seen in an ovarian cancer cell ine (CT=33.1). Thus, expression of this gene could be used to differentiate between this sample and other samples on this panel. Please see Panel 1.3D for further discussion of the utility of this gene in cancer.

As in the previous panel, this gene is also expressed in the brain, including the cerebral cortex, substantia nigra and thalamus. Please see Panel 1.3D for discussion of utility of this gene in the central nervous system.

General_screening_panel_v1.5 Summary: Ag6049 Results from one experiment with the CG55794-06 gene are not included. The amp plot indicates that there were experimental difficulties with this run.

Panel 1.3D Summary: Ag2622 Two experiments with the same probe and primer sets produce results that are in reasonable agreement, with highest expression of the CG55794-01 gene in the brain and the kidney. Interestingly, there is significantly lower expression in the brain cancer cell lines than normal brain samples. This suggests that absence of this gene might be involved in cell proliferation. Hence this might be used as a diagnostic marker for brain cancer.

As seen in previous panels, the CG55794-01 gene is also expressed at low levels in the CNS. Carboxypeptidase is believed to have a role in the degradation of APP and A-beta, the major component of senile plaques in Alzheimer's disease. Therapeutic upregulation of this gene or its protein product may therefore be of benefit in the treatment of Alzheimer's disease.

REFERENCES

Matsumoto A, Itoh K, Matsumoto R. A novel carboxypeptidase B that processes native beta-amyloid precursor protein is present in human hippocampus. Eur J Neurosci 2000 January; 12(1):227–38

The processing of beta-amyloid precursor protein (APP) and generation of beta-amyloid (Abeta) are associated with the pathophysiology of Alzheimer's disease (AD). As the proteases responsible for the process in the human brain have yet to be clarified, we have searched for activities capable of cleaving native brain APP in the human hippocampus. A 40-kDa protein with proteolytic activity that degrades native brain APP in vitro was purified and characterized; molecular analysis identified it as a novel protease belonging to the carboxypeptidase B (CPB) family. PC12 cells overexpressing the cDNA encoding this protease generate a major 12-kDa beta-amyloid-bearing peptide in cytosol, a peptide which has also been detected in a cell-free system using purified brain APP as substrate. Although the protease is homologous to plasma CPB synthesized in liver, it has specific domains such as C-terminal 14 amino acid residues. Western analysis, cDNA-cloning process and Northern analysis suggested a brain-specific expression of this protease. An immunohistochemical study showed that the protease is expressed in various neuronal perikarya, including those of pyramidal neurons of the hippocampus and ependymal-choroid plexus cells, and in a portion of the microglia of normal brains. In brains of patients with sporadic AD, there is decreased neuronal expression of the protease, and clusters of microglia with protease immunoreactivity associated with its extracellular deposition are detected. These findings suggest that brain CPB has a physiological function in APP processing and may have significance in AD pathophysiology.

Panel 2D Summary: Ag2622 The CG55794-01 gene is expressed at low levels in the tissues used for panel 2D, with reasonable concordance between the runs. There is increased expression in normal prostate and kidney compared to the adjacent tumor tissues. There is also increased expression in breast cancer tissues compared to normal breast tissue. Hence, expression of this gene can be used as a diagnostic marker in breast, prostate and kidney cancer. Furthermore, therapeutic modulation of the gene product might be of use in the treatment of these cancers.

Panel 3D Summary: Ag2622 Expression of the CG55794-01 gene is low/undetectable in all samples on this panel (CTs>35).

Panel 4D Summary: Ag2622 The CG55794-01 gene, which encodes a putative carboxypeptidase, is expressed in the colon and down regulated in colon tissue isolated from Crohn's and colitis patients. The carboxypeptidase family of enzymes has been found in the colon and is associated with colon disease (ref. below). Thus, the expression of the transcript or the protein it encodes could be used to detect normal colon tissue. Furthermore, therapeutics designed with the protein encoded for by this transcript could be important in the treatment of IBD. Ag6049 Results from one experiment with the CG55794-06 gene showed low/undetectable in all samples on Panel 4.1D. (CTs>35).

REFERENCES

Sommer H, Schweisfurth H, Schulz M. Serum angiotensin-I-converting enzyme and carboxypeptidase N in Crohn's disease and ulcerative colitis. Enzyme 1986; 35(4):181–8

Angiotensin-I-converting enzyme (ACE) and carboxypeptidase N1 and N2 (CPN1, CPN2) inactivate kinins and might therefore play a role in the development of inflammatory reactions via an influence on the release of prostaglandins and inactivation of anaphylatoxic peptides of the complement system. In the present study, the serum activity of these enzymes was determined in 60 patients with Crohn's disease, 18 patients with ulcerative colitis and 70 healthy control subjects. ACE was significantly lowered in active Crohn's disease (CDAI greater than 150) and in ulcerative colitis (p less than 0.01), as long as the ileum or cecum was affected. Since ACE was detected in high concentrations in the human intestinal mucosa, decreased values may be explained by damage to the site of its production. CPN1 and CPN2 were raised in both diseases (p less than 0.005), irrespective of their activity and location. These alterations in the activity of the kininases investigated may play a role in the pathogenesis of inflammatory bowel diseases.

Panel 5 Islet Summary: Ag3953 The CG55794-01 gene, a carboxypeptidase homolog, has little to no expression in any of the endocrine/metabolically-related tissues except for small intestine. This expression profile is in agreement with the results from Panel 4D. Carboxypeptidase-B processing of GI peptides (e.g. GLP-2 and CCK) is critical for bioactivity. Thus, a therapeutic modulator of this gene and/or gene-product may prove useful in treating diseases associated with the GI tract and metabolism.

REFERENCES

Orskov C, Buhl T, Rabenhoj L, Kofod H, Holst J J. Carboxypeptidase-B-like processing of the C-terminus of glucagon-like peptide-2 in pig and human small intestine. FEBS Lett 1989 Apr. 24; 247(2):193–6

We developed specific, C-terminal radioimmunoassays for three proglucagon (PG) fragments: PG 151–158, PG 151–160 and PG 126–159 (glucagon-like peptide-2 (GLP-2] in order to determine the exact C-terminal sequence of the newly isolated GLP-2 in man and pig. The antigens and the antisera showed no mutual cross-reactivity. By gel filtration of extracts of pig and human small intestine, the immunoreactivity eluting at the position of GLP-2 was identified by the radioimmunoassays for glucagon-like peptide-2 (PG 126–159) and for PG 151–158, whereas the assay for PG 151–160 was completely negative. We conclude that the C-terminal amino acid residue of pig and human ileal GLP-2 is PG 158. Thus the basic residues, PG 159 and 160 are removed during its processing in the small intestine.

PMID: 2714431

Blanke S E, Johnsen A H, Rehfeld J F. N-terminal fragments of intestinal cholecystokinin: evidence for release of CCK-8 by cleavage on the carboxyl side of Arg74 of proCCK. Regul Pept 1993 Jul. 23; 46(3):575–82

From porcine duodenal mucosa we have identified three major procholecystokinin (proCCK) fragments: desoctaCCK-33, desnonaCCK-33 and desnonaCCK-39. (DesoctaCCK-33 means CCK-33 devoid of the 8 C-terminal amino acids, etc.). The fragments were purified by immunoaffinity chromatography and three steps of reverse phase HPLC monitored by a radioimmunoassay specific for the N-terminal part of CCK-33. The structures could be deduced from the proCCK sequence by N-terminal sequence determination and mass spectrometry. Whereas desnona-fragments of CCK have been described before, this is the first finding of a desoctaCCK, and it indicates that CCK-8 is released from the longer forms by endogenous cleavage of the Arg-Asp-bond. A carboxypeptidase B-like exopeptidase subsequently must produce the desnona-fragments by removing the arginine residue.

NOV8d: CG55794-07: Splice Variant of CG55794-01

Expression of gene CG55794-07 was assessed using the primer-probe sets Ag2622, Ag6050 and Ag3953, described in Tables GA, GB and GC. Results of the RTQ-PCR runs are shown in Tables GD, GE, GF, GG, GH, GI, GJ and GK.

TABLE GA

Probe Name Ag2622

| Primers | Sequences | Length | Start Position |
|---|---|---|---|
| Forward | 5'-catcagggtcttcaagagattg-3' (SEQ ID NO:368) | 22 | 971 |
| Probe | TET-5'-ccgagacattgggattcccttctcat-3'-TAMRA (SEQ ID NO:369) | 26 | 996 |
| Reverse | 5'-acaaacccatatgttccactgt-3' (SEQ ID NO:370) | 22 | 1040 |

TABLE GB

Probe Name Ag6050

| Primers | Sequences | Length | Start Position |
|---|---|---|---|
| Forward | 5'-gttgatcgtcttcacggaaag-3' (SEQ ID NO:371) | 21 | 68 |
| Probe | TET-5'-cctaccacatgttggccagggtg-3'-TAMRA (SEQ ID NO:372) | 23 | 104 |
| Reverse | 5'-aagtgttttctctttcactgcttg-3' (SEQ ID NO:373) | 24 | 129 |

TABLE GC

Probe Name Ag3953

| Primers | Sequences | Length | Start Position |
|---|---|---|---|
| Forward | 5'-acagtggaacatatgggtttgt-3' (SEQ ID NO:374) | 22 | 1040 |
| Probe | TET-5'-agaagctcagatccagcccacctgt-3'-TAMRA (SEQ ID NO: 375) | 25 | 1068 |
| Reverse | 5'-catacacatcatccaggactga-3' (SEQ ID NO:376) | 22 | 1117 |

TABLE GD

CNS_neurodegeneration_v1.0

| Tissue Name | Rel. Exp. (%) Ag2622, Run 206942830 | Rel. Exp. (%) Ag6050, Run 226208787 |
|---|---|---|
| AD 1 Hippo | 8.6 | 18.3 |
| AD 2 Hippo | 31.2 | 40.6 |
| AD 3 Hippo | 18.2 | 18.4 |
| AD 4 Hippo | 5.4 | 6.5 |
| AD 5 hippo | 63.3 | 87.7 |
| AD 6 Hippo | 27.0 | 60.7 |
| Control 2 Hippo | 35.6 | 26.4 |
| Control 4 Hippo | 17.7 | 18.0 |
| Control (Path) 3 Hippo | 9.2 | 13.8 |
| AD 1 Temporal Ctx | 13.8 | 35.1 |
| AD 2 Temporal Ctx | 53.6 | 52.5 |
| AD 3 Temporal Ctx | 4.5 | 24.0 |
| AD 4 Temporal Ctx | 24.1 | 52.9 |
| AD 5 Inf Temporal Ctx | 84.7 | 97.3 |
| AD 5 SupTemporal Ctx | 28.1 | 43.5 |
| AD 6 Inf Temporal Ctx | 70.2 | 77.4 |
| AD 6 Sup Temporal Ctx | 100.0 | 98.6 |
| Control 1 Temporal Ctx | 2.9 | 10.3 |
| Control 2 Temporal Ctx | 13.6 | 34.9 |
| Control 3 Temporal Ctx | 8.7 | 29.9 |
| Control 4 Temporal Ctx | 19.5 | 16.0 |
| Control (Path) 1 Temporal Ctx | 47.0 | 85.9 |
| Control (Path) 2 Temporal Ctx | 54.3 | 67.8 |
| Control (Path) 3 Temporal Ctx | 9.0 | 14.7 |
| Control (Path) 4 Temporal Ctx | 54.0 | 70.7 |
| AD 1 Occipital Ctx | 18.0 | 31.6 |
| AD 2 Occipital Ctx Missing | 0.0 | 0.0 |
| AD 3 Occipital Ctx | 7.0 | 14.5 |
| AD 4 Occipital Ctx | 21.6 | 30.1 |
| AD 5 Occipital Ctx | 15.3 | 20.7 |
| AD 6 Occipital Ctx | 51.1 | 54.0 |
| Control 1 Occipital Ctx | 0.0 | 5.5 |
| Control 2 Occipital Ctx | 33.7 | 50.3 |
| Control 3 Occipital Ctx | 24.5 | 29.1 |
| Control 4 Occipital Ctx | 9.0 | 6.1 |
| Control (Path) 1 Occipital Ctx | 87.1 | 100.0 |
| Control (Path) 2 Occipital Ctx | 10.2 | 34.9 |
| Control (Path) 3 Occipital Ctx | 9.3 | 4.4 |
| Control (Path) 4 Occipital Ctx | 18.4 | 26.4 |
| Control 1 Parietal Ctx | 2.3 | 11.4 |
| Control 2 Parietal Ctx | 58.2 | 99.3 |
| Control 3 Parietal Ctx | 10.9 | 25.7 |
| Control (Path) 1 Parietal Ctx | 65.5 | 79.0 |
| Control (Path) 2 Parietal Ctx | 17.1 | 34.4 |
| Control (Path) 3 Parietal Ctx | 3.6 | 6.2 |
| Control (Path) 4 Parietal Ctx | 27.5 | 57.8 |

TABLE GE

General_screening_panel_v1.4

| Tissue Name | Rel. Exp. (%) Ag3953, Run 213856130 |
|---|---|
| Adipose | 9.3 |
| Melanoma* Hs688(A).T | 0.0 |
| Melanoma* Hs688(B).T | 11.1 |
| Melanoma* M14 | 0.0 |
| Melanoma* LOXIMVI | 6.4 |
| Melanoma* SK-MEL-5 | 0.0 |
| Squamous cell carcinoma SCC-4 | 4.1 |
| Testis Pool | 3.0 |
| Prostate ca.* (bone met) PC-3 | 0.0 |
| Prostate Pool | 18.4 |
| Placenta | 0.0 |
| Uterus Pool | 5.8 |
| Ovarian ca. OVCAR-3 | 0.0 |
| Ovarian ca. SK-OV-3 | 100.0 |
| Ovarian ca. OVCAR-4 | 0.0 |
| Ovarian ca. OVCAR-5 | 25.5 |

TABLE GE-continued

General_screening_panel_v1.4

| Tissue Name | Rel. Exp. (%) Ag3953, Run 213856130 |
|---|---|
| Ovarian ca. IGROV-1 | 0.0 |
| Ovarian ca. OVCAR-8 | 0.0 |
| Ovary | 16.0 |
| Breast ca. MCF-7 | 8.5 |
| Breast ca. MDA-MB-231 | 3.7 |
| Breast ca. BT 549 | 4.8 |
| Breast ca. T47D | 26.1 |
| Breast ca. MDA-N | 0.0 |
| Breast Pool | 7.2 |
| Trachea | 0.0 |
| Lung | 18.6 |
| Fetal Lung | 3.3 |
| Lung ca. NCI-N417 | 5.4 |
| Lung ca. LX-1 | 0.0 |
| Lung ca. NCI-H146 | 4.1 |
| Lung ca. SHP-77 | 11.3 |
| Lung ca. A549 | 0.0 |
| Lung ca. NCI-H526 | 4.2 |
| Lung ca. NCI-H23 | 13.4 |
| Lung ca. NCI-H460 | 10.3 |
| Lung ca HOP-62 | 6.7 |
| Lung ca. NCI-H522 | 26.6 |
| Liver | 0.0 |
| Fetal Liver | 4.7 |
| Liver ca. HepG2 | 0.0 |
| Kidney Pool | 40.1 |
| Fetal Kidney | 17.1 |
| Renal ca. 786-0 | 12.2 |
| Renal ca. A498 | 6.7 |
| Renal ca. ACHN | 0.0 |
| Renal ca. UO-31 | 3.1 |
| Renal ca. TK-10 | 24.3 |
| Bladder | 13.6 |
| Gastric ca. (liver met.) NCI-N87 | 39.5 |
| Gastric ca. KATO III | 0.0 |
| Colon ca. SW-948 | 8.5 |
| Colon ca. SW480 | 0.0 |
| Colon ca.* (SW480 met) SW620 | 0.0 |
| Colon ca. HT29 | 0.0 |
| Colon ca. HCT-116 | 40.6 |
| Colon ca. CaCo-2 | 0.0 |
| Colon cancer tissue | 0.0 |
| Colon ca. SW1116 | 5.2 |
| Colon ca. Colo-205 | 0.0 |
| Colon ca. SW-48 | 0.0 |
| Colon Pool | 21.3 |
| Small Intestine Pool | 13.8 |
| Stomach Pool | 8.0 |
| Bone Marrow Pool | 2.6 |
| Fetal Heart | 0.0 |
| Heart Pool | 1.7 |
| Lymph Node Pool | 14.2 |
| Fetal Skeletal Muscle | 0.0 |
| Skeletal Muscle Pool | 31.0 |
| Spleen Pool | 7.9 |
| Thymus Pool | 12.2 |
| CNS cancer (glio/astro) U87-MG | 0.0 |
| CNS cancer (glio/astro) U-118-MG | 5.9 |
| CNS cancer (neuro; met) SK-N-AS | 6.2 |
| CNS cancer (astro) SF-539 | 4.8 |
| CNS cancer (astro) SNB-75 | 39.2 |
| CNS cancer (glio) SNB-19 | 9.5 |
| CNS cancer (glio) SF-295 | 3.6 |
| Brain (Amygdala) Pool | 53.6 |
| Brain (cerebellum) | 0.0 |
| Brain (fetal) | 15.9 |
| Brain (Hippocampus) Pool | 25.5 |
| Cerebral Cortex Pool | 47.3 |
| Brain (*Substantia nigra*) Pool | 42.6 |
| Brain (Thalamus) Pool | 58.2 |
| Brain (whole) | 9.5 |
| Spinal Cord Pool | 46.0 |
| Adrenal Gland | 0.0 |
| Pituitary gland Pool | 12.9 |
| Salivary Gland | 3.3 |
| Thyroid (female) | 11.5 |
| Pancreatic ca. CAPAN2 | 0.0 |
| Pancreas Pool | 26.6 |

TABLE GF

General_screening_panel_v1.5

| Tissue Name | Rel. Exp. (%) Ag6050, Run 228746661 |
|---|---|
| Adipose | 9.2 |
| Melanoma* Hs688(A).T | 3.0 |
| Melanoma* Hs688(B).T | 2.1 |
| Melanoma* M14 | 0.0 |
| Melanoma* LOXIMVI | 0.0 |
| Melanoma* SK-MEL-5 | 0.7 |
| Squamous cell carcinoma SCC-4 | 2.4 |
| Testis Pool | 18.0 |
| Prostate ca.* (bone met) PC-3 | 0.5 |
| Prostate Pool | 31.6 |
| Placenta | 1.8 |
| Uterus Pool | 15.4 |
| Ovarian ca. OVCAR-3 | 2.9 |
| Ovarian Ca. SK-OV-3 | 100.0 |
| Ovarian ca. OVCAR-4 | 1.3 |
| Ovarian ca. OVCAR-5 | 17.4 |
| Ovarian ca. IGROV-1 | |
| Ovarian ca. IGROV-8 | 0.0 |
| Ovary | 12.6 |
| Breast ca. MCF-7 | 5.3 |
| Breast ca. MDA-MB-231 | 5.9 |
| Breast ca. BT 549 | 7.6 |
| Breast ca. T47D | 0.0 |
| Breast ca. MDA-N | 1.0 |
| Breast Pool | 27.4 |
| Trachea | 11.1 |
| Lung | 13.6 |
| Fetal Lung | 18.3 |
| Lung ca. NCI-N417 | 0.0 |
| Lung ca. LX-1 | 4.4 |
| Lung ca. NCI-H146 | 4.2 |
| Lung ca. SHP-77 | 1.0 |
| Lung ca. A549 | 2.0 |
| Lung ca. NCI-H526 | 0.6 |
| Lung ca. NCI-H23 | 12.1 |
| Lung ca. NCI-H460 | 31.9 |
| Lung ca. HOP-62 | 8.9 |
| Lung ca. NCI-H522 | 8.5 |
| Liver | 1.5 |
| Fetal Liver | 7.5 |
| Liver ca. HepG2 | 0.6 |
| Kidney Pool | 23.2 |
| Fetal Kidney | 58.2 |
| Renal ca. 786-0 | 3.0 |
| Renal ca. A498 | 7.7 |
| Renal ca. ACHN | 1.8 |
| Renal ca. UO-31 | 2.9 |
| Renal ca. TK-10 | 11.0 |
| Bladder | 13.0 |
| Gastric ca. (liver met.) NCI-N87 | 47.6 |
| Gastric ca. KATO III | 0.0 |
| Colon ca. SW-948 | 1.5 |
| Colon ca. SW480 | 2.0 |
| Colon ca.* (SW480 met) SW620 | 4.2 |
| Colon ca. HT29 | 0.0 |
| Colon ca. HCT-116 | 28.3 |
| Colon ca. CaCo-2 | 3.3 |
| Colon cancer tissue | 4.0 |
| Colon ca. SW1116 | 2.1 |

TABLE GF-continued

General_screening_panel_v1.5

| Tissue Name | Rel. Exp. (%) Ag6050, Run 228746661 |
|---|---|
| Colon ca. Colo-205 | 0.0 |
| Colon ca. SW-48 | 1.0 |
| Colon Pool | 14.0 |
| Small Intestine Pool | 16.0 |
| Stomach Pool | 11.8 |
| Bone Marrow Pool | 8.1 |
| Fetal Heart | 3.8 |
| Heart Pool | 14.3 |
| Lymph Node Pool | 21.5 |
| Fetal Skeletal Muscle | 3.5 |
| Skeletal Muscle Pool | 36.9 |
| Spleen Pool | 9.7 |
| Thymus Pool | 10.7 |
| CNS cancer (glio/astro) U87-MG | 1.0 |
| CNS cancer (glio/astro) U-118-MG | 5.3 |
| CNS cancer (neuro; met) SK-N-AS | 2.7 |
| CNS cancer (astro) SF-539 | 1.3 |
| CNS cancer (astro) SNB-75 | 14.9 |
| CNS cancer (glio) SNB-19 | 1.4 |
| CNS cancer (glio) SF-295 | 12.2 |
| Brain (Amygdala) Pool | 27.5 |
| Brain (cerebellum) | 16.4 |
| Brain (fetal) | 14.5 |
| Brain (Hippocampus) Pool | 24.0 |
| Cerebral Cortex Pool | 47.0 |
| Brain (*Substantia nigra*) Pool | 24.5 |
| Brain (Thalamus) Pool | 62.0 |
| Brain (whole) | 20.9 |
| Spinal Cord Pool | 20.3 |
| Adrenal Gland | 15.3 |
| Pituitary gland Pool | 19.2 |
| Salivary Gland | 5.8 |
| Thyroid (female) | 7.8 |
| Pancreatic ca. CAPAN2 | 0.5 |
| Pancreas Pool | 21.0 |

TABLE GG

Panel 1.3D

| Tissue Name | Rel. Exp. (%) Ag2622, Run 162554681 | Rel. Exp. (%) Ag2622, Run 165672349 |
|---|---|---|
| Liver adenocarcinoma | 0.0 | 0.0 |
| Pancreas | 0.0 | 0.0 |
| Pancreatic ca. CAPAN 2 | 0.0 | 10.3 |
| Adrenal gland | 7.4 | 33.7 |
| Thyroid | 46.7 | 7.7 |
| Salivary gland | 0.0 | 21.2 |
| Pituitary gland | 14.8 | 40.9 |
| Brain (fetal) | 13.8 | 0.0 |
| Brain (whole) | 60.3 | 75.3 |
| Brain (amygdala) | 61.6 | 28.9 |
| Brain (cerebellum) | 6.2 | 0.0 |
| Brain (hippocampus) | 47.3 | 97.9 |
| Brain (*substantia nigra*) | 28.5 | 82.9 |
| Brain (thalamus) | 54.0 | 100.0 |
| Cerebral Cortex | 0.0 | 27.7 |
| Spinal cord | 77.4 | 28.7 |
| glio/astro U87-MG | 0.0 | 0.0 |
| glio/astro U-118-MG | 6.5 | 10.7 |
| astrocytoma SW1783 | 8.3 | 0.0 |
| neuro*; met SK-N-AS | 0.0 | 0.0 |
| astrocytoma SF-539 | 0.0 | 0.0 |
| astrocytoma SNB-75 | 7.6 | 19.8 |
| glioma SNB-19 | 13.2 | 14.4 |
| glioma U251 | 7.5 | 0.0 |
| glioma SF-295 | 0.0 | 0.0 |
| Heart (fetal) | 0.0 | 0.0 |
| Heart | 0.0 | 0.0 |
| Skeletal muscle (fetal) | 7.1 | 11.3 |
| Skeletal muscle | 84.7 | 57.0 |
| Bone marrow | 0.0 | 0.0 |
| Thymus | 19.6 | 0.0 |
| Spleen | 0.0 | 13.2 |
| Lymph node | 0.0 | 0.0 |
| Colorectal | 5.8 | 28.3 |
| Stomach | 0.0 | 0.0 |
| Small intestine | 7.6 | 24.5 |
| Colon ca. SW480 | 0.0 | 0.0 |
| Colon ca.* SW620 (SW480 met) | 0.0 | 10.2 |
| Colon ca. HT29 | 0.0 | 0.0 |
| Colon ca. HCT-116 | 19.9 | 0.0 |
| Colon ca. CaCo-2 | 0.0 | 0.0 |
| Colon ca. tissue (ODO3866) | 16.8 | 9.0 |
| Colon ca. HCC-2998 | 12.5 | 0.0 |
| Gastric ca.* (liver met) NCI-N87 | 27.0 | 13.3 |
| Bladder | 28.9 | 12.4 |
| Trachea | 13.6 | 0.0 |
| Kidney | 100.0 | 28.5 |
| Kidney (fetal) | 10.5 | 0.0 |
| Renal ca. 786-0 | 0.0 | 0.0 |
| Renal ca. A498 | 7.0 | 22.2 |
| Renal ca. RXF 393 | 0.0 | 8.5 |
| Renal ca. ACHN | 0.0 | 0.0 |
| Renal ca. UO-31 | 0.0 | 0.0 |
| Renal ca. TK-10 | 0.0 | 0.0 |
| Liver | 0.0 | 0.0 |
| Liver (fetal) | 6.8 | 0.0 |
| Liver ca. (hepatoblast) HepG2 | 0.0 | 0.0 |
| Lung | 19.8 | 10.8 |
| Lung (fetal) | 23.2 | 48.6 |
| Lung ca. (small cell) LX-1 | 0.0 | 0.0 |
| Lung ca. (small cell) NCI-H69 | 0.0 | 0.0 |
| Lung ca. (s. cell var.) SHP-77 | 0.0 | 0.0 |
| Lung ca. (large cell) NCI-H460 | 0.0 | 0.0 |
| Lung ca. (non-sm. cell) A549 | 0.0 | 0.0 |
| Lung ca. (non-s. cell) NCI-H23 | 0.0 | 23.7 |
| Lung ca. (non-s. cell) HOP-62 | 0.0 | 10.2 |
| Lung ca. (non-s. cl) NCI-H522 | 0.0 | 14.8 |
| Lung ca. (squam.) SW 900 | 0.0 | 26.4 |
| Lung ca. (squam.) NCI-H596 | 0.0 | 0.0 |
| Mammary gland | 13.0 | 0.0 |
| Breast ca.* (pl. ef) MCF-7 | 0.0 | 0.0 |
| Breast ca.* (pl. ef) MDA-MB-231 | 0.0 | 0.0 |
| Breast ca.* (pl. ef) T47D | 0.0 | 0.0 |
| Breast ca. BT-549 | 2.6 | 27.2 |
| Breast ca. MDA-N | 0.0 | 0.0 |
| Ovary | 24.1 | 0.0 |
| Ovarian ca. OVCAR-3 | 0.0 | 5.8 |
| Ovarian ca. OVCAR-4 | 0.0 | 0.0 |
| Ovarian ca. OVCAR-5 | 0.0 | 0.0 |
| Ovarian ca. OVCAR-8 | 0.0 | 0.0 |
| Ovarian ca. IGROV-1 | 0.0 | 0.0 |
| Ovarian ca.* (ascites) SK-OV-3 | 11.3 | 62.9 |
| Uterus | 0.0 | 33.9 |
| Placenta | 0.0 | 0.0 |
| Prostate | 13.3 | 0.0 |
| Prostate ca.* (bone met) PC-3 | 0.0 | 0.0 |
| Testis | 22.2 | 23.0 |
| Melanoma Hs688(A).T | 0.0 | 0.0 |
| Melanoma* (met) Hs688(B).T | 0.0 | 0.0 |
| Melanoma UACC-62 | 0.0 | 0.0 |
| Melanoma M14 | 0.0 | 0.0 |
| Melanoma LOX IMVI | 0.0 | 0.0 |
| Melanoma* (met) SK-MEL-5 | 0.0 | 0.0 |
| Adipose | 14.0 | 9.7 |

TABLE GH

Panel 2D

| Tissue Name | Rel. Exp. (%) Ag2622, Run 163578215 | Rel. Exp. (%) Ag2622, Run 165910584 |
|---|---|---|
| Normal Colon | 7.3 | 20.4 |
| CC Well to Mod Diff (ODO3866) | 0.4 | 0.0 |
| CC Margin (ODO3866) | 2.7 | 2.7 |
| CC Gr.2 rectosigmoid (ODO3868) | 3.3 | 0.0 |
| CC Margin (ODO3868) | 0.5 | 6.6 |
| CC Mod Diff (ODO3920) | 0.0 | 0.0 |
| CC Margin (ODO3920) | 3.4 | 10.4 |
| CC Gr.2 ascend colon (ODO3921) | 2.8 | 4.7 |
| CC Margin (ODO3921) | 1.9 | 5.5 |
| CC from Partial Hepatectomy (ODO4309) Mets | 1.2 | 2.0 |
| Liver Margin (ODO4309) | 1.0 | 4.5 |
| Colon mets to lung (OD04451-01) | 0.0 | 0.0 |
| Lung Margin (OD04451-02) | 0.7 | 1.8 |
| Normal Prostate 6546-1 | 30.4 | 27.7 |
| Prostate Cancer (OD04410) | 7.9 | 15.9 |
| Prostate Margin (OD04410) | 13.9 | 47.3 |
| Prostate Cancer (OD04720-01) | 5.5 | 8.7 |
| Prostate Margin (OD04720-02) | 9.2 | 37.6 |
| Normal Lung 061010 | 4.6 | 5.3 |
| Lung Met to Muscle (ODO4286) | 0.7 | 2.6 |
| Muscle Margin (ODO4286) | 5.3 | 19.6 |
| Lung Malignant Cancer (OD03126) | 2.4 | 3.7 |
| Lung Margin (OD03126) | 4.6 | 7.2 |
| Lung Cancer (OD04404) | 1.2 | 1.7 |
| Lung Margin (OD04404) | 1.5 | 3.6 |
| Lung Cancer (OD04565) | 0.0 | 0.0 |
| Lung Margin (OD04565) | 0.0 | 1.5 |
| Lung Cancer (OD04237-01) | 3.9 | 17.4 |
| Lung Margin (OD04237-02) | 0.6 | 6.5 |
| Ocular Mel Met to Liver (ODO4310) | 0.0 | 2.4 |
| Liver Margin | 1.4 | 1.3 |
| Melanoma Mets to Lung (OD04321) | 1.0 | 2.5 |
| Lung Margin (OD04321) | 0.9 | 8.5 |
| Normal Kidney | 34.4 | 100.0 |
| Kidney Ca, Nuclear grade 2 (OD04338) | 4.8 | 16.5 |
| Kidney Margin (OD04338) | 3.9 | 27.4 |
| Kidney Ca Nuclear grade 1/2 (OD04339) | 10.8 | 26.4 |
| Kidney Margin (OD04339) | 21.8 | 55.1 |
| Kidney Ca, Clear cell type (OD04340) | 0.8 | 1.8 |
| Kidney Margin (OD04340) | 11.8 | 41.2 |
| Kidney Ca, Nuclear grade 3 (OD04348) | 0.0 | 0.0 |
| Kidney Margin (OD04348) | 17.9 | 28.3 |
| Kidney Cancer (OD04622-01) | 1.9 | 2.3 |
| Kidney Margin (OD04622-03) | 4.6 | 2.4 |
| Kidney Cancer (OD04450-01) | 2.1 | 6.5 |
| Kidney Margin (OD04450-03) | 16.5 | 47.3 |
| Kidney Cancer 8120607 | 0.6 | 0.0 |
| Kidney Margin 8120608 | 0.8 | 0.0 |
| Kidney Cancer 8120613 | 0.0 | 1.4 |
| Kidney Margin 8120614 | 1.6 | 3.3 |
| Kidney Cancer 9010320 | 0.9 | 1.9 |
| Kidney Margin 9010321 | 5.2 | 12.4 |
| Normal Uterus | 0.5 | 0.0 |
| Uterus Cancer 064011 | 4.6 | 9.4 |
| Normal Thyroid | 8.2 | 9.7 |
| Thyroid Cancer 064010 | 1.2 | 10.2 |
| Thyroid Cancer A302152 | 2.8 | 2.1 |
| Thyroid Margin A302153 | 7.4 | 19.2 |
| Normal Breast | 1.9 | 4.7 |
| Breast Cancer (OD04566) | 4.7 | 6.1 |
| Breast Cancer (OD04590-01) | 1.3 | 5.2 |
| Breast Cancer Mets (OD04590-03) | 100.0 | 4.0 |
| Breast Cancer Metastasis (OD04655-05) | 17.3 | 33.9 |
| Breast Cancer 064006 | 16.6 | 14.3 |
| Breast Cancer 1024 | 8.2 | 39.8 |
| Breast Cancer 9100266 | 1.0 | 2.4 |
| Breast Margin 9100265 | 0.5 | 2.0 |
| Breast Cancer A209073 | 0.0 | 17.0 |
| Breast Margin A2090734 | 2.3 | 5.3 |
| Normal Liver | 3.1 | 9.3 |
| Liver Cancer 064003 | 0.3 | 0.0 |
| Liver Cancer 1025 | 0.8 | 0.0 |
| Liver Cancer 1026 | 0.0 | 0.0 |
| Liver Cancer 6004-T | 0.4 | 4.6 |
| Liver Tissue 6004-N | 0.0 | 0.0 |
| Liver Cancer 6005-T | 0.5 | 0.0 |
| Liver Tissue 6005-N | 0.0 | 0.0 |
| Normal Bladder | 2.0 | 10.0 |
| Bladder Cancer 1023 | 0.6 | 0.0 |
| Bladder Cancer A302173 | 6.9 | 9.0 |
| Bladder Cancer (OD04718-01) | 1.0 | 1.7 |
| Bladder Normal Adjacent (OD04718-03) | 3.1 | 10.2 |
| Normal Ovary | 1.6 | 4.2 |
| Ovarian Cancer 064008 | 2.2 | 8.3 |
| Ovarian Cancer (OD04768-07) | 0.0 | 0.0 |
| Ovary Margin (OD04768-08) | 0.0 | 3.2 |
| Normal Stomach | 2.1 | 0.0 |
| Gastric Cancer 9060358 | 0.0 | 0.0 |
| Stomach Margin 9060359 | 0.0 | 4.5 |
| Gastric Cancer 9060395 | 2.0 | 0.0 |
| Stomach Margin 9060394 | 3.4 | 10.8 |
| Gastric Cancer 9060397 | 1.3 | 0.0 |
| Stomach Margin 9060396 | 0.0 | 2.7 |
| Gastric Cancer 064005 | 1.8 | 13.6 |

TABLE GI

Panel 4.1D

| Tissue Name | Rel. Exp. (%) Ag6050, Run 226202118 |
|---|---|
| Secondary Th1 act | 0.6 |
| Secondary Th2 act | 1.7 |
| Secondary Tr1 act | 0.7 |
| Secondary Th1 rest | 1.6 |
| Secondary Th2 rest | 0.0 |
| Secondary Tr1 rest | 0.8 |
| Primary Th1 act | 0.6 |
| Primary Th2 act | 2.2 |
| Primary Tr1 act | 1.2 |
| Primary Th1 rest | 0.4 |
| Primary Th2 rest | 0.0 |
| Primary Tr1 rest | 0.3 |
| CD45RA CD4 lymphocyte act | 1.7 |
| CD45RO CD4 lymphocyte act | 5.1 |
| CD8 lymphocyte act | 2.1 |
| Secondary CD8 lymphocyte rest | 5.8 |
| Secondary CD8 lymphocyte act | 0.4 |
| CD4 lymphocyte none | 0.3 |
| 2ry Th1/Th2/Tr1_anti-CD95 CH11 | 0.6 |
| LAK cells rest | 0.8 |
| LAK cells IL-2 | 1.8 |
| LAK cells IL-2 + IL-12 | 1.1 |
| LAK cells IL-2 + IFN gamma | 4.2 |
| LAK cells IL-2 + IL-18 | 2.6 |
| LAK cells PMA/ionomycin | 0.3 |
| NK Cells IL-2 rest | 2.0 |
| Two Way MLR 3 day | 1.4 |
| Two Way MLR 5 day | 2.5 |
| Two Way MLR 7 day | 0.4 |
| PBMC rest | 0.6 |
| PBMC PWM | 2.5 |
| PBMC PHA-L | 2.4 |
| Ramos (B cell) none | 0.0 |
| Ramos (B cell) ionomycin | 0.0 |
| B lymphocytes PWM | 1.6 |
| B lymphocytes CD40L and IL-4 | 1.8 |
| EOL-1 dbcAMP | 8.4 |

TABLE GI-continued

Panel 4.1D

| Tissue Name | Rel. Exp. (%) Ag6050, Run 226202118 |
| --- | --- |
| EOL-1 dbcAMP PMA/ionomycin | 8.2 |
| Dendritic cells none | 0.5 |
| Dendritic cells LPS | 1.7 |
| Dendritic cells anti-CD40 | 0.9 |
| Monocytes rest | 2.0 |
| Monocytes LPS | 0.3 |
| Macrophages rest | 1.7 |
| Macrophages LPS | 0.0 |
| HUVEC none | 0.3 |
| HUVEC starved | 1.2 |
| HUVEC IL-1 beta | 0.4 |
| HUVEC IFN gamma | 1.8 |
| HUVEC TNF alpha + IFN gamma | 1.2 |
| HUVEC TNF alpha + IL4 | 1.2 |
| HUVEC IL-11 | 1.1 |
| Lung Microvascular EC none | 5.9 |
| Lung Microvascular EC TNF alpha + IL-1 beta | 1.6 |
| Microvascular Dermal EC none | 1.5 |
| Microvasular Dermal EC TNF alpha + IL-1 beta | 0.3 |
| Bronchial epithelium TNF alpha + IL1 beta | 3.6 |
| Small airway epithelium none | 1.0 |
| Small airway epithelium TNF alpha + IL-1 beta | 8.5 |
| Coronery artery SMC rest | 0.4 |
| Coronery artery SMC TNF alpha + IL-1 beta | 0.0 |
| Astrocytes rest | 1.0 |
| Astrocytes TNF alpha + IL-1 beta | 3.1 |
| KU-812 (Basophil) rest | 0.0 |
| KU-812 (Basophil) PMA/ionomycin | 1.3 |
| CCD1106 (Keratinocytes) none | 2.0 |
| CCD1106 (Keratinocytes) TNF alpha + IL-1 beta | 1.5 |
| Liver cirrhosis | 1.2 |
| NCI-H292 none | 0.3 |
| NCI-H292 IL-4 | 0.7 |
| NCI-H292 IL-9 | 3.1 |
| NCI-H292 IL-13 | 0.7 |
| NCI-H292 IFN gamma | 1.7 |
| HPAEC none | 1.2 |
| HPAEC TNF alpha + IL-1 beta | 2.3 |
| Lung fibroblast none | 1.3 |
| Lung fibroblast TNF alpha + IL-1 beta | 1.6 |
| Lung fibroblast IL-4 | 4.4 |
| Lung fibroblast IL-9 | 5.4 |
| Lung fibroblast IL-13 | 4.0 |
| Lung fibroblast IFN gamma | 3.4 |
| Dermal fibroblast CCD1070 rest | 1.1 |
| Dermal fibroblast CCD1070 TNF alpha | 0.7 |
| Dermal fibroblast CCD1070 IL-1 beta | 0.3 |
| Dermal fibroblast IFN gamma | 3.0 |
| Dermal fibroblast IL-4 | 1.9 |
| Dermal Fibroblasts rest | 1.7 |
| Neutrophils TNFa + LPS | 0.0 |
| Neutrophils rest | 2.2 |
| Colon | 2.5 |
| Lung | 1.6 |
| Thymus | 19.9 |
| Kidney | 100.0 |

TABLE GJ

Panel 4D

| Tissue Name | Rel. Exp. (%) Ag2622, Run 162554700 | Rel. Exp. (%) Ag2622, Run 165806297 |
| --- | --- | --- |
| Secondary Th1 act | 0.0 | 0.1 |
| Secondary Th2 act | 0.1 | 0.0 |
| Secondary Tr1 act | 0.0 | 0.0 |
| Secondary Th1 rest | 0.0 | 0.0 |
| Secondary Th2 rest | 0.0 | 0.0 |
| Secondary Tr1 rest | 0.0 | 0.0 |
| Lung Primary Th1 act | 0.0 | 0.0 |
| Primary Th2 act | 0.2 | 0.0 |
| Primary Tr1 act | 0.0 | 0.0 |
| Primary Th1 rest | 0.0 | 0.0 |
| Primary Th2 rest | 0.1 | 0.0 |
| Primary Tr1 rest | 0.2 | 0.0 |
| CD45RA CD4 lymphocyte act | 0.0 | 0.0 |
| CD45RO CD4 lymphocyte act | 0.1 | 0.1 |
| CD8 lymphocyte act | 0.0 | 0.0 |
| Secondary CD8 lymphocyte rest | 0.0 | 0.0 |
| Secondary CD8 lymphocyte act | 0.0 | 0.0 |
| CD4 lymphocyte none | 0.2 | 0.0 |
| 2ry Th1/Th2/Tr1_anti-CD95 CH11 | 0.0 | 0.0 |
| LAK cells rest | 0.0 | 0.0 |
| LAK cells IL-2 | 0.0 | 0.0 |
| LAK cells IL-2 + IL-12 | 0.0 | 0.0 |
| LAK cells IL-2 + IFN gamma | 0.1 | 0.1 |
| LAK cells IL-2 + IL-18 | 0.1 | 0.0 |
| LAK cells PMA/ionomycin | 0.0 | 0.0 |
| NK Cells IL-2 rest | 0.1 | 0.0 |
| Two Way MLR 3 day | 0.0 | 0.0 |
| Two Way MLR 5 day | 0.0 | 0.0 |
| Two Way MLR 7 day | 0.0 | 0.0 |
| PBMC rest | 0.0 | 0.0 |
| PBMC PWM | 0.3 | 0.1 |
| PBMC PHA-L | 0.1 | 0.0 |
| Ramos (B cell) none | 0.0 | 0.0 |
| Ramos (B cell) ionomycin | 0.0 | 0.0 |
| B lymphocytes PWM | 0.1 | 0.0 |
| B lymphocytes CD40L and IL-4 | 0.0 | 0.0 |
| EOL-1 dbcAMP | 0.0 | 0.0 |
| EOL-1 dbcAMP PMA/ionomycin | 0.2 | 0.1 |
| Dendritic cells none | 0.0 | 0.0 |
| Dendritic cells LPS | 0.0 | 0.1 |
| Dendritic cells anti-CD40 | 0.0 | 0.0 |
| Monocytes rest | 0.0 | 0.0 |
| Monocytes LPS | 0.0 | 0.0 |
| Macrophages rest | 0.0 | 0.0 |
| Macrophages LPS | 0.0 | 0.0 |
| HUVEC none | 0.0 | 0.0 |
| HUVEC starved | 0.0 | 0.0 |
| HUVEC IL-1 beta | 0.0 | 0.0 |
| HUVEC IFN gamma | 0.3 | 0.0 |
| HUVEC TNF alpha + IFN gamma | 0.0 | 0.0 |
| HUVEC TNF alpha + IL4 | 0.0 | 0.0 |
| HUVEC IL-11 | 0.0 | 0.0 |
| Lung Microvascular EC none | 0.4 | 0.1 |
| Lung Microvascular EC TNF alpha + IL-1 beta | 0.0 | 0.0 |
| Microvascular Dermal EC none | 0.0 | 0.0 |
| Microvasular Dermal EC TNF alpha + IL-1 beta | 0.1 | 0.0 |
| Bronchial epithelium TNF alpha + IL1 beta | 0.0 | 0.1 |
| Small airway epithelium none | 0.0 | 0.1 |
| Small airway epithelium TNF alpha + IL-1 beta | 1.1 | 0.4 |
| Coronery artery SMC rest | 0.0 | 0.0 |
| Coronery artery SMC TNF alpha + IL-1 beta | 0.0 | 0.0 |
| Astrocytes rest | 0.0 | 0.0 |
| TNF alpha + IL-1 beta | 0.2 | 0.2 |
| KU-812 (Basophil) rest | 0.0 | 0.0 |
| KU-812 (Basophil) PMA/ionomycin | 0.1 | 0.0 |
| CCD1106 (Keratinocytes) none | 0.0 | 0.0 |
| CCD1106 (Keratinocytes) TNF alpha + IL-1 beta | 0.0 | 0.1 |

TABLE GJ-continued

Panel 4D

| Tissue Name | Rel. Exp. (%) Ag2622, Run 162554700 | Rel. Exp. (%) Ag2622, Run 165806297 |
|---|---|---|
| Liver cirrhosis | 0.8 | 0.6 |
| Lupus kidney | 0.2 | 0.4 |
| NCI-H292 none | 0.0 | 0.0 |
| NCI-H292 IL-4 | 0.0 | 0.0 |
| NCI-H292 IL-9 | 0.0 | 0.1 |
| NCI-H292 IL-13 | 0.0 | 0.0 |
| NCI-H292 IFN gamma | 0.1 | 0.0 |
| HPAEC none | 0.1 | 0.0 |
| HPAEC TNF alpha + IL-1 beta | 0.0 | 0.0 |
| Lung fibroblast none | 0.1 | 0.0 |
| Lung fibroblast TNF alpha + IL-1 beta | 0.1 | 0.0 |
| Lung fibroblast IL-4 | 0.0 | 0.1 |
| Lung fibroblast IL-9 | 0.4 | 0.1 |
| Lung fibroblast IL-13 | 0.1 | 0.0 |
| Lung fibroblast IFN gamma | 0.5 | 0.1 |
| Dermal fibroblast CCD1070 rest | 0.1 | 0.1 |
| Dermal fibroblast CCD1070 TNF alpha | 0.0 | 0.0 |
| Dermal fibroblast CCD1070 IL-1 beta | 0.0 | 0.0 |
| Dermal fibroblast IFN gamma | 0.1 | 0.0 |
| Dermal fibroblast IL-4 | 0.0 | 0.1 |
| IBD Colitis 2 | 0.0 | 0.0 |
| IBD Crohn's | 1.0 | 2.2 |
| Colon | 100.0 | 100.0 |
| Lung | 0.2 | 0.0 |
| Thymus | 1.3 | 0.9 |
| Kidney | 0.5 | 0.0 |

TABLE GK

Panel 5 Islet

| Tissue Name | Rel. Exp. (%) Ag3953, Run 223846464 |
|---|---|
| 97457_Patient-02go_adipose | 0.0 |
| 97476_Patient-07sk_skeletal muscle | 0.0 |
| 97477_Patient-07ut_uterus | 0.0 |
| 97478_Patient-07pl_placenta | 0.0 |
| 99167_Bayer Patient 1 | 0.0 |
| 97482_Patient-08ut_uterus | 0.0 |
| 97483_Patient-08pl_placenta | 3.7 |
| 97486_Patient-09sk_skeletal muscle | 0.0 |
| 97487_Patient-09ut_uterus | 3.8 |
| 97488_Patient-09pl_placenta | 0.0 |
| 97492_Patient-10ut_uterus | 0.0 |
| 97493_Patient-10pl_placenta | 0.0 |
| 97495_Patient-11go_adipose | 0.0 |
| 97496_Patient-11sk_skeletal muscle | 3.3 |
| 97497_Patient-11ut_uterus | 0.0 |
| 97498_Patient-11pl_placenta | 4.0 |
| 97500_Patient-12go_adipose | 4.2 |
| 97501_Patient-12sk_skeletal muscle | 3.5 |
| 97502_Patient-12ut_uterus | 0.0 |
| 97503_Patient-12pl_placenta | 0.0 |
| 94721_Donor 2 U - A_Mesenchymal Stem Cells | 0.0 |
| 94722_Donor 2 U - B_Mesenchymal Stem Cells | 4.0 |
| 94723_Donor 2 U - C_Mesenchymal Stem Cells | 0.0 |
| 94709_Donor 2 AM - A_adipose | 0.0 |
| 94710_Donor 2 AM - B_adipose | 0.0 |
| 94711_Donor 2 AM - C_adipose | 0.0 |
| 94712_Donor 2 AD - A_adipose | 0.0 |
| 94713_Donor 2 AD - B_adipose | 0.0 |
| 94714_Donor 2 AD - C_adipose | 0.0 |
| 94742_Donor 3 U - A_Mesenchymal Stem Cells | 0.0 |
| 94743_Donor 3 U - B_Mesenchymal Stem Cells | 0.0 |
| 94730_Donor 3 AM - A_adipose | 4.4 |
| 94731_Donor 3 AM - B_adipose | 0.0 |
| 94732_Donor 3 AM - C_adipose | 0.0 |
| 94733_Donor 3 AD - A_adipose | 0.0 |
| 94734_Donor 3 AD - B_adipose | 0.0 |
| 94735_Donor 3 AD - C_adipose | 3.6 |
| 77138_Liver_HepG2untreated | 0.0 |
| 73556_Heart_Cardiac stromal cells (primary) | 0.0 |
| 81735_Small Intestine | 100.0 |
| 72409_Kidney_Proximal Convoluted Tubule | 0.0 |
| 82685_Small intestine_Duodenum | 0.0 |
| 90650_Adrenal_Adrenocortical adenoma | 0.0 |
| 72410_Kidney_HRCE | 0.0 |
| 72411_Kidney_HRE | 0.0 |
| 73139_Uterus_Uterine smooth muscle cells | 0.0 |

CNS_neurodegeneration_v1.0 Summary: Ag2622/Ag6050 Two experiments with two different probe and primer sets confirm the expression of the CG55794-07 gene in the CNS; See panel 1.3d for a discussion of utility of this gene in the central nervous system.

General_screening_panel_v1.4 Summary/General_screening panel_v1.5 Summary: Ag3953/Ag6050 Two experiments with two different probe and primer sets show highest expression of the CG55794-07 gene is seen in an ovarian cancer cell line (CT=33.1). Thus, expression of this gene could be used to differentiate between this sample and other samples on this panel. Please see Panel 1.3D for further discussion of the utility of this gene in cancer.

As in the previous panel, this gene is also expressed in the brain, including the cerebral cortex, substantia nigra and thalamus. Please see Panel 1.3D for discussion of utility of this gene in the central nervous system.

Panel 1.3D Summary: Ag2622 Two experiments with the same probe and primer sets produce results that are in reasonable agreement, with highest expression of the CG55794-07 gene in the brain and the kidney. Interestingly, there is significantly lower expression in the brain cancer cell lines than normal brain samples. This suggests that absence of this gene might be involved in cell proliferation. Hence this might be used as a diagnostic marker for brain cancer.

As seen in previous panels, the CG55794-07 gene is also expressed at low levels in the CNS. Carboxypeptidase is believed to have a role in the degradation of APP and A-beta, the major component of senile plaques in Alzheimer's disease. Therapeutic upregulation of this gene or its protein product may therefore be of benefit in the treatment of Alzheimer's disease.

REFERENCES

Matsumoto A, Itoh K, Matsumoto R. A novel carboxypeptidase B that processes native beta-amyloid precursor protein is present in human hippocampus. Eur J Neurosci 2000 January; 12(1):22738

The processing of beta-amyloid precursor protein (APP) and generation of beta-amyloid (Abeta) are associated with the pathophysiology of Alzheimer's disease (AD). As the proteases responsible for the process in the human brain have yet to be clarified, we have searched for activities capable of cleaving native brain APP in the human hippocampus. A 40-kDa protein with proteolytic activity that degrades native brain APP in vitro was purified and characterized; molecular analysis identified it as a novel protease belonging to the carboxypeptidase B (CPB) family. PC 12 cells overexpressing the cDNA encoding this protease generate a major 12-kDa beta-amyloid-bearing peptide in cytosol, a peptide which has also been detected in a cell-free system using purified brain APP as substrate. Although the protease is homologous to plasma CPB synthesized in liver, it has specific domains such as C-terminal 14 amino acid residues. Western analysis, cDNA-cloning process and Northern analysis suggested a brain-specific expression of this protease. An immunohistochemical study showed that the protease is expressed in various neuronal perikarya, including those of pyramidal neurons of the hippocampus and ependymal-choroid plexus cells, and in a portion of the microglia of normal brains. In brains of patients with sporadic AD, there is decreased neuronal expression of the protease, and clusters of microglia with protease immunoreactivity associated with its extracellular deposition are detected. These findings suggest that brain CPB has a physiological function in APP processing and may have significance in AD pathophysiology.

Panel 2D Summary: Ag2622 The CG55794-07 gene is expressed at low levels in the tissues used for panel 2D, with reasonable concordance between the runs. There is increased expression in normal prostate and kidney compared to the adjacent tumor tissues. There is also increased expression in breast cancer tissues compared to normal breast tissue. Hence, expression of this gene can be used as a diagnostic marker in breast, prostate and kidney cancer. Furthermore, therapeutic modulation of the gene product might be of use in the treatment of these cancers.

Panel 3D Summary: Ag2622 Expression of the CG55794-07 gene is low/undetectable in all samples on this panel (CTs>35).

Panel 4.1D Summary: Ag6050 The CG55794-07 transcript is expressed in EOL cells, fibroblasts and in normal kidney, thymus and colon. Low expression is noted in T cells, LAK cells, and B cells. The expression pattern with this set of primers and probe, which is specific to this gene, is different than that seen with the Ag2622 probe and primers, particularly in the colon, wheere expression of the transcript is comparatively low. Thus, this transcript or the protein it encodes could be used to identify the tissues where it is expressed, including kidney, and thymus.

Panel 4D Summary: Ag 2622 In two experiments with the same probe and primer set, the CG55794-07 gene, which encodes a putative carboxypeptidase, is expressed in the colon and down regulated in colon tissue isolated from Crohn's and colitis patients. The carboxypeptidase family of enzymes has been found in the colon and is associated with colon disease (ref. below). Thus, the expression of the transcript or the protein it encodes could be used to detect normal colon tissue. Furthermore, therapeutics designed with the protein encoded for by this transcript could be important in the treatment of IBD.

REFERENCES

Sommer H, Schweisfurth H, Schulz M. Serum angiotensin-I-converting enzyme and carboxypeptidase N in Crohn's disease and ulcerative colitis. Enzyme 1986; 35(4):181–8
Angiotensin-I-converting enzyme (ACE) and carboxypeptidase N1 and N2 (CPN1, CPN2) inactivate kinins and might therefore play a role in the development of inflammatory reactions via an influence on the release of prostaglandins and inactivation of anaphylatoxic peptides of the complement system. In the present study, the serum activity of these enzymes was determined in 60 patients with Crohn's disease, 18 patients with ulcerative colitis and 70 healthy control subjects. ACE was significantly lowered in active Crohn's disease (CDAI greater than 150) and in ulcerative colitis (p less than 0.01), as long as the ileum or cecum was affected. Since ACE was detected in high concentrations in the human intestinal mucosa, decreased values may be explained by damage to the site of its production. CPN1 and CPN2 were raised in both diseases (p less than 0.005), irrespective of their activity and location. These alterations in the activity of the kininases investigated may play a role in the pathogenesis of inflammatory bowel diseases.

Panel 5 Islet Summary: Ag3953 The CG55794-07 gene, a carboxypeptidase homolog, has little to no expression in any of the endocrine/metabolically-related tissues except for small intestine. This expression profile is in agreement with the results from Panel 4D. Carboxypeptidase-B processing of GI peptides (e.g. GLP-2 and CCK) is critical for bioactivity. Thus, a therapeutic modulator of this gene and/or gene-product may prove useful in treating diseases associated with the GI tract and metabolism.

REFERENCES

Orskov C, Buhl T, Rabenhoj L, Kofod H, Holst J J. Carboxypeptidase-B-like processing of the C-terminus of glucagon-like peptide-2 in pig and human small intestine. FEBS Lett 1989 Apr. 24; 247(2):193–6
We developed specific, C-terminal radioimmunoassays for three proglucagon (PG) fragments: PG 151–158, PG 151–160 and PG 126–159 (glucagon-like peptide-2 (GLP-2] in order to determine the exact C-terminal sequence of the newly isolated GLP-2 in man and pig. The antigens and the antisera showed no mutual cross-reactivity. By gel filtration of extracts of pig and human small intestine, the immunoreactivity eluting at the position of GLP-2 was identified by the radioimmunoassays for glucagon-like peptide-2 (PG 126–159) and for PG 151–158, whereas the assay for PG 151–160 was completely negative. We conclude that the C-terminal amino acid residue of pig and human ileal GLP-2 is PG 158. Thus the basic residues, PG 159 and 160 are removed during its processing in the small intestine.
PMID: 2714431
Blanke S E, Johnsen A H, Rehfeld J F. N-terminal fragments of intestinal cholecystokinin: evidence for release of CCK-8 by cleavage on the carboxyl side of Arg74 of proCCK. Regul Pept 1993 Jul. 23; 46(3):575–82
From porcine duodenal mucosa we have identified three major procholecystokinin (proCCK) fragments: desoctaCCK-33, desnonaCCK-33 and desnonaCCK-39. (DesoctaCCK-33 means CCK-33 devoid of the 8 C-terminal amino acids, etc.). The fragments were purified by immunoaffinity chromatography and three steps of reverse phase HPLC monitored by a radioimmunoassay specific for the N-terminal part of CCK-33. The structures could be deduced from the proCCK sequence by N-terminal sequence determination and mass spectrometry. Whereas desnona-fragments of CCK have been described before, this is the first finding of a desoctaCCK, and it indicates that CCK-8 is released from the longer forms by endogenous cleavage of the Arg-Asp-bond. A carboxypeptidase B-like exopeptidase subsequently must produce the desnona-fragments by removing the arginine residue.

NOV10: CG56321-01: Novel Human MAF-Like Protein

Expression of gene CG56321-01 was assessed using the primer-probe set Ag3095, described in Table HA. Results of the RTQ-PCR runs are shown in Tables HB, HC, HD and HE.

TABLE HA

Probe Name Ag3095

| Primers | Sequences | Length | Start Position |
|---|---|---|---|
| Forward | 5'-agaagtgccaactccagagc-3' (SEQ ID NO: 377) | 20 | 938 |
| Probe | TET-5'-aggtggagcagctgaagctggaggt-3'-TAMRA (SEQ ID NO: 378) | 25 | 959 |
| Reverse | 5'-cttgtacaggtcccgctctt-3' (SEQ ID NO: 379) | 20 | 998 |

TABLE HB

Panel 1.3D

| Tissue Name | Rel. Exp. (%) Ag3095, Run 167985248 |
|---|---|
| Liver adenocarcinoma | 0.0 |
| Pancreas | 9.3 |
| Pancreatic ca. CAPAN 2 | 0.0 |
| Adrenal gland | 0.0 |
| Thyroid | 0.5 |
| Salivary gland | 0.0 |
| Pituitary gland | 0.0 |
| Brain (fetal) | 0.0 |
| Brain (whole) | 0.0 |
| Brain (amygdala) | 6.3 |
| Brain (cerebellum) | 0.0 |
| Brain (hippocampus) | 0.0 |
| Brain (substantia nigra) | 0.0 |
| Brain (thalamus) | 0.0 |
| Cerebral Cortex | 1.6 |
| Spinal cord | 0.0 |
| glio/astro U87-MG | 0.0 |
| glio/astro U-118-MG | 0.0 |
| astrocytoma SW1783 | 0.0 |
| neuro*; met SK-N-AS | 0.0 |
| astrocytoma SF-539 | 0.8 |
| astrocytoma SNB-75 | 0.4 |
| glioma SNB-19 | 0.0 |
| glioma U251 | 2.0 |
| glioma SF-295 | 0.0 |
| Heart (fetal) | 0.0 |
| Heart | 0.0 |
| Skeletal muscle (fetal) | 100.0 |
| Skeletal muscle | 61.1 |
| Bone marrow | 0.0 |
| Thymus | 0.0 |
| Spleen | 0.0 |
| Lymph node | 0.0 |
| Colorectal | 2.6 |
| Stomach | 0.0 |
| Small intestine | 0.0 |
| Colon ca. SW480 | 1.9 |
| Colon ca.* SW620 (SW480 met) | 0.0 |
| Colon ca. HT29 | 0.0 |
| Colon ca. HCT-116 | 0.9 |
| Colon ca. CaCo-2 | 0.6 |
| Colon ca. tissue (ODO3866) | 0.0 |
| Colon ca. HCC-2998 | 0.0 |
| Gastric ca.* (liver met) NCI-N87 | 2.1 |
| Bladder | 4.1 |
| Trachea | 0.0 |
| Kidney | 1.0 |
| Kidney (fetal) | 0.0 |
| Renal ca. 786-0 | 0.0 |
| Renal ca. A498 | 1.3 |
| Renal ca. RXF 393 | 0.8 |
| Renal ca. ACHN | 0.0 |
| Renal ca. UO-31 | 0.0 |
| Renal ca. TK-10 | 1.3 |
| Liver | 0.0 |
| Liver (fetal) | 0.0 |
| Liver ca. (hepatoblast) HepG2 | 1.0 |
| Lung | 0.0 |
| Lung (fetal) | 0.0 |
| Lung ca. (small cell) LX-1 | 0.0 |
| Lung ca. (small cell) NCI-H69 | 12.0 |
| Lung ca. (s. cell var.) SHP-77 | 1.6 |
| Lung ca. (large cell) NCI-H460 | 0.0 |
| Lung ca. (non-sm. cell) A549 | 1.0 |
| Lung ca. (non-s. cell) NCI-H23 | 9.2 |
| Lung ca. (non-s. cell) HOP-62 | 0.0 |
| lung ca. (non-s. cl) NCI-H522 | 14.6 |
| Lung ca. (squam.) SW 900 | 0.0 |
| Lung ca. (squam.) NCI-H596 | 2.2 |
| Mammary gland | 0.0 |
| Breast ca.* (pl. ef) MCF-7 | 2.2 |
| Breast ca.* (pl. ef) MDA-MB-231 | 0.0 |
| Breast ca.* (pl. ef) T47D | 6.5 |
| Breast ca. BT-549 | 0.0 |
| Breast ca. MDA-N | 0.0 |
| Ovary | 0.0 |
| Ovarian ca. OVCAR-3 | 0.0 |
| Ovarian ca. OVCAR-4 | 4.2 |
| Ovarian ca. OVCAR-5 | 9.5 |
| Ovarian ca. OVCAR-8 | 5.7 |
| Ovarian ca. IGROV-1 | 0.0 |
| Ovarian ca.* (ascites) SK-OV-3 | 1.6 |
| Uterus | 0.0 |
| Placenta | 2.6 |
| Prostate | 0.0 |
| Prostate ca.* (bone met) PC-3 | 0.0 |
| Testis | 6.9 |
| Melanoma Hs688(A).T | 0.6 |
| Melanoma* (met) Hs688(B).T | 0.0 |
| Melanoma UACC-62 | 1.3 |
| Melanoma M14 | 0.0 |
| Melanoma LOX IMVI | 0.0 |
| Melanoma* (met) SK-MEL-5 | 0.4 |
| Adipose | 2.9 |

TABLE HC

Panel 2.2

| Tissue Name | Rel. Exp. (%) Ag3095, Run 174268954 |
|---|---|
| Normal Colon | 0.0 |
| Colon cancer (OD06064) | 0.0 |
| Colon Margin (OD06064) | 0.0 |
| Colon cancer (OD06159) | 0.0 |
| Colon Margin (OD06159) | 0.0 |
| Colon cancer (OD06297-04) | 0.0 |
| Colon Margin (OD06297-015) | 0.0 |
| CC Gr. 2 ascend colon (ODO3921) | 0.0 |
| CC Margin (ODO3921) | 2.1 |
| Colon cancer metastasis (OD06104) | 0.0 |
| Lung Margin (OD06104) | 0.0 |
| Colon mets to lung (OD04451-01) | 0.0 |
| Lung Margin (OD04451-02) | 3.7 |
| Normal Prostate | 0.0 |
| Prostate Cancer (OD04410) | 0.0 |
| Prostate Margin (OD04410) | 3.2 |
| Normal Ovary | 0.0 |
| Ovarian cancer (OD06283-03) | 0.0 |
| Ovarian Margin (OD06283-07) | 0.0 |
| Ovarian Cancer 064008 | 4.0 |
| Ovarian cancer (OD06145) | 0.0 |

TABLE HC-continued

Panel 2.2

| Tissue Name | Rel. Exp. (%) Ag3095, Run 174268954 |
|---|---|
| Ovarian Margin (OD06145) | 0.0 |
| Ovarian cancer (OD06455-03) | 0.0 |
| Ovarian Margin (OD06455-07) | 0.0 |
| Normal Lung | 0.0 |
| Invasive poor diff. lung adeno (ODO4945-01) | 0.0 |
| Lung Margin (ODO4945-03) | 0.0 |
| Lung Malignant Cancer (OD03126) | 0.0 |
| Lung Margin (OD03126) | 0.0 |
| Lung Cancer (OD05014A) | 4.2 |
| Lung Margin (OD05014B) | 0.0 |
| Lung cancer (OD06081) | 3.4 |
| Lung Margin (OD06081) | 0.0 |
| Lung Cancer (OD04237-01) | 2.6 |
| Lung Margin (OD04237-02) | 9.8 |
| Ocular Melanoma Metastasis | 0.0 |
| Ocular Melanoma Margin (Liver) | 0.0 |
| Melanoma Metastasis | 0.0 |
| Melanoma Margin (Lung) | 0.0 |
| Normal Kidney | 0.0 |
| Kidney Ca, Nuclear grade 2 (OD04338) | 0.0 |
| Kidney Margin (OD04338) | 0.0 |
| Kidney Ca Nuclear grade 1/2 (OD04339) | 0.0 |
| Kidney Margin (OD04339) | 4.6 |
| Kidney Ca, Clear cell type (OD04340) | 0.0 |
| Kidney Margin (OD04340) | 4.0 |
| Kidney Ca, Nuclear grade 3 (OD04348) | 0.0 |
| Kidney Margin (OD04348) | 0.0 |
| Kidney malignant cancer (OD06204B) | 0.0 |
| Kidney normal adjacent tissue (OD06204E) | 4.3 |
| Kidney Cancer (OD04450-01) | 0.0 |
| Kidney Margin (OD04450-03) | 3.9 |
| Kidney Cancer 8120613 | 0.0 |
| Kidney Margin 8120614 | 0.0 |
| Kidney Cancer 9010320 | 0.0 |
| Kidney Margin 9010321 | 0.0 |
| Kidney Cancer 8120607 | 0.0 |
| Kidney Margin 8120608 | 0.0 |
| Normal Uterus | 0.0 |
| Uterine Cancer 064011 | 0.0 |
| Normal Thyroid | 0.0 |
| Thyroid Cancer 064010 | 0.0 |
| Thyroid Cancer A302152 | 0.0 |
| Thyroid Margin A302153 | 3.4 |
| Normal Breast | 0.0 |
| Breast Cancer (OD04566) | 0.0 |
| Breast Cancer 1024 | 0.0 |
| Breast Cancer (OD04590-01) | 0.0 |
| Breast Cancer Mets (OD04590-03) | 0.0 |
| Breast Cancer Metastasis (OD04655-05) | 0.0 |
| Breast Cancer 064006 | 0.0 |
| Breast Cancer 9100266 | 0.0 |
| Breast Margin 9100265 | 0.0 |
| Breast Cancer A209073 | 3.1 |
| Breast Margin A2090734 | 0.0 |
| Breast cancer (OD06083) | 4.4 |
| Breast cancer node metastasis (OD06083) | 4.3 |
| Normal Liver | 0.0 |
| Liver Cancer 1026 | 31.6 |
| Liver Cancer 1025 | 0.0 |
| Liver Cancer 6004-T | 0.0 |
| Liver Tissue 6004-N | 0.0 |
| Liver Cancer 6005-T | 97.3 |
| Liver Tissue 6005-N | 0.0 |
| Liver Cancer 064003 | 100.0 |
| Normal Bladder | 0.0 |
| Bladder Cancer 1023 | 0.0 |
| Bladder Cancer A302173 | 0.0 |
| Normal Stomach | 0.0 |
| Gastric Cancer 9060397 | 0.0 |
| Stomach Margin 9060396 | 4.5 |
| Gastric Cancer 9060395 | 0.0 |
| Stomach Margin 9060394 | 0.0 |
| Gastric Cancer 064005 | 0.0 |

TABLE HD

Panel 4D

| Tissue Name | Rel. Exp. (%) Ag3095, Run 164392099 |
|---|---|
| Secondary Th1 act | 4.7 |
| Secondary Th2 act | 2.6 |
| Secondary Tr1 act | 0.5 |
| Secondary Th1 rest | 2.5 |
| Secondary Th2 rest | 6.6 |
| Secondary Tr1 rest | 4.2 |
| Primary Th1 act | 9.5 |
| Primary Th2 act | 4.8 |
| Primary Tr1 act | 3.2 |
| Primary Th1 rest | 3.1 |
| Primary Th2 rest | 5.8 |
| Primary Tr1 rest | 0.0 |
| CD45RA CD4 lymphocyte act | 0.0 |
| CD45RO CD4 lymphocyte act | 3.0 |
| CD8 lymphocyte act | 0.0 |
| Secondary CD8 lymphocyte rest | 2.2 |
| Secondary CD8 lymphocyte act | 3.4 |
| CD4 lymphocyte none | 0.0 |
| 2ry Th1/Th2/Tr1_anti-CD95 CH11 | 18.4 |
| LAK cells rest | 0.9 |
| LAK cells IL-2 | 0.8 |
| LAK cells IL-2 + IL-12 | 1.1 |
| LAK cells IL-2 + IFN gamma | 2.7 |
| LAK cells IL-2 + IL-18 | 2.0 |
| LAK cells PMA/ionomycin | 100.0 |
| NK Cells IL-2 rest | 1.5 |
| Two Way MLR 3 day | 0.6 |
| Two Way MLR 5 day | 0.7 |
| Two Way MLR 7 day | 2.8 |
| PBMC rest | 0.0 |
| PBMC PWM | 1.9 |
| PBMC PHA-L | 0.8 |
| Ramos (B cell) none | 0.0 |
| Ramos (B cell) ionomycin | 1.1 |
| B lymphocytes PWM | 52.5 |
| B lymphocytes CD40L and IL-4 | 62.4 |
| EOL-1 dbcAMP | 17.1 |
| EOL-1 dbcAMP PMA/ionomycin | 56.6 |
| Dendritic cells none | 1.8 |
| Dendritic cells LPS | 0.9 |
| Dendritic cells anti-CD40 | 3.1 |
| Monocytes rest | 0.0 |
| Monocytes LPS | 54.3 |
| Macrophages rest | 1.0 |
| Macrophages LPS | 0.0 |
| HUVEC none | 0.0 |
| HUVEC starved | 3.5 |
| HUVEC IL-1beta | 0.0 |
| HUVEC IFN gamma | 0.0 |
| HUVEC TNF alpha + IFN gamma | 0.0 |
| HUVEC TNF alpha + IL4 | 0.0 |
| HUVEC IL-11 | 0.0 |
| Lung Microvascular EC none | 0.0 |
| Lung Microvascular EC TNFalpha + IL-1beta | 0.0 |
| Microvascular Dermal EC none | 1.0 |
| Microsvasular Dermal EC TNFalpha + IL-1beta | 0.8 |
| Bronchial epithelium TNFalpha + IL1beta | 0.0 |
| Small airway epithelium none | 0.5 |
| Small airway epithelium TNFalpha + IL-1beta | 0.0 |
| Coronery artery SMC rest | 0.0 |
| Coronery artery SMC TNFalpha + IL-1beta | 0.0 |
| Astrocytes rest | 0.0 |
| Astrocytes TNFalpha + IL-1beta | 0.0 |
| KU-812 (Basophil) rest | 0.0 |
| KU-812 (Basophil) PMA/ionomycin | 7.0 |
| CCD1106 (Keratinocytes) none | 0.0 |
| CCD1106 (Keratinocytes) TNFalpha + IL-1beta | 0.7 |
| Liver cirrhosis | 4.2 |
| Lupus kidney | 0.0 |
| NCI-H292 none | 0.0 |
| NCI-H292 IL-4 | 2.1 |
| NCI-H292 IL-9 | 0.0 |
| NCI-H292 IL-13 | 0.6 |
| NCI-H292 IFN gamma | 0.9 |

TABLE HD-continued

Panel 4D

| Tissue Name | Rel. Exp. (%) Ag3095, Run 164392099 |
|---|---|
| HPAEC none | 0.0 |
| HPAEC TNF alpha + IL-1 beta | 0.0 |
| Lung fibroblast none | 0.0 |
| Lung fibroblast TNF alpha + IL-1 beta | 0.3 |
| Lung fibroblast IL-4 | 0.7 |
| Lung fibroblast IL-9 | 0.0 |
| Lung fibroblast IL-13 | 0.0 |
| Lung fibroblast IFN gamma | 0.0 |
| Dermal fibroblast CCD1070 rest | 0.0 |
| Dermal fibroblast CCD1070 TNF alpha | 1.4 |
| Dermal fibroblast CCD1070 IL-1 beta | 0.0 |
| Dermal fibroblast IFN gamma | 0.0 |
| Dermal fibroblast IL-4 | 0.0 |
| IBD Colitis 2 | 0.0 |
| IBD Crohn's | 0.0 |
| Colon | 26.2 |
| Lung | 9.2 |
| Thymus | 0.0 |
| Kidney | 3.1 |

TABLE HE

Panel 5D

| Tissue Name | Rel. Exp. (%) Ag3095, Run 172171202 |
|---|---|
| 97457_Patient-02go_adipose | 0.0 |
| 97476_Patient-07sk_skeletal muscle | 3.5 |
| 97477_Patient-07ut_uterus | 0.0 |
| 97478_Patient-07pl_placenta | 5.3 |
| 97481_Patient-08sk_skeletal muscle | 14.5 |
| 97482_Patient-08ut_uterus | 0.0 |
| 97483_Patient-08pl_placenta | 0.0 |
| 97486_Patient-09sk_skeletal muscle | 14.7 |
| 97487_Patient-09ut_uterus | 0.0 |
| 97488_Patient-09pl_placenta | 3.7 |
| 97492_Patient-10ut_uterus | 0.0 |
| 97493_Patient-10pl_placenta | 11.9 |
| 97495_Patient-11go_adipose | 0.0 |
| 97496_Patient-11sk_skeletal muscle | 8.1 |
| 97497_Patient-11ut_uterus | 0.0 |
| 97498_Patient-11pl_placenta | 2.3 |
| 97500_Patient-12go_adipose | 0.0 |
| 97501_Patient-12sk_skeletal muscle | 100.0 |
| 97502_Patient-12ut_uterus | 0.0 |
| 97503_Patient-12pl_placenta | 6.2 |
| 94721_Donor 2 U - A_Mesenchymal Stem Cells | 0.0 |
| 94722_Donor 2 U - B_Mesenchymal Stem Cells | 0.0 |
| 94723_Donor 2 U - C_Mesenchymal Stem Cells | 1.3 |
| 94709_Donor 2 AM - A_adipose | 0.0 |
| 94710_Donor 2 AM - B_adipose | 0.0 |
| 94711_Donor 2 AM - C_adipose | 0.0 |
| 94712_Donor 2 AD - A_adipose | 0.0 |
| 94713_Donor 2 AD - B_adipose | 0.0 |
| 94714_Donor 2 AD - C_adipose | 0.0 |
| 94742_Donor 3 U - A_Mesenchymal Stem Cells | 2.9 |
| 94743_Donor 3 U - B_Mesenchymal Stem Cells | 0.0 |
| 94730_Donor 3 AM - A_adipose | 0.0 |
| 94731_Donor 3 AM - B_adipose | 0.0 |
| 94732_Donor 3 AM - C_adipose | 0.0 |
| 94733_Donor 3 AD - A_adipose | 0.0 |
| 94734_Donor 3 AD - B_adipose | 0.0 |
| 94735_Donor 3 AD - C_adipose | 0.0 |
| 77138_Liver_HepG2untreated | 0.0 |
| 73556_Heart_Cardiac stromal cells (primary) | 0.0 |
| 81735_Small Intestine | 0.0 |
| 72409_Kidney_Proximal Convoluted Tubule | 2.5 |
| 82685_Small intestine_Duodenum | 0.0 |
| 90650_Adrenal_Adrenocortical adenoma | 4.2 |
| 72410_Kidney_HRCE | 0.0 |
| 72411_Kidney_HRE | 0.0 |
| 73139_Uterus_Uterine smooth muscle cells | 3.8 |

Panel 1.3D Summary: Ag3095 The CG56321-01 gene is expressed predominantly in skeletal muscle and pancreas (CTs=30–33) as well as in several lung and ovarian cancer cell lines. MAF-like proteins are known to be involved in regulating differentiation. Thus, expression of this gene could be used to differentiate between these samples and other samples on this panel. Furthermore, therapeutic modulation of the expression or function of this gene product may be effective in the treatment of cancers that affects these tissues.

Panel 2.2 Summary: Ag3095 Expression of the CG56321-01 gene is restricted to samples derived from liver cancer cell lines (CT=34.4). Thus, expression of this gene could be used to differentiate between this sample and other samples on this panel and as a marker to detect the presence of liver cancer. Furthermore, therapeutic modulation of the expression or function of this gene may be effective in the treatment of liver cancer.

Panel 4D Summary: Ag3095 Highest expression of the CG56321-01 gene is seen in LAK cells stimulated with PMA/ionomycin (CT=31.3). Significant levels of expression are also seen in activated B lymphocytes and eosinophils. Owing to the importance of eosinophils and T cells in lung pathology, inflammatory bowel disease and autoimmune disorders, including rheumatoid arthritis, antibody or small molecule therapies designed with the protein encoded by this gene could block or inhibit inflammation or tissue damage due to lung conditions including asthma, allergies, hypersensitivity reactions, inflammatory bowel disease, viral infections and autoimmune disease. Detection of this gene product in LAK cells also suggests that modulation of the function of this gene product with a small molecule drug or antibody may lead to improvement of symptoms associated with tumor immunology and tumor cell clearance, as well as removal of virally and bacterial infected cells.

Panel 5D Summary: Ag3095 The CG56321-01 gene is expressed exclusively in skeletal muscle of an individual who is diagnosed with gestational diabetes and is being treated with insulin (CT=33). Thus, the physiological role of this gene product may extend beyond regulating differentiation and also include regulating the physiology of skeletal muscle under conditions of metabolic stress.

NOV11a and NOV11b: CG56381-01 and CG56381-02: Lysyl Oxidase

Expression of gene CG56381-01 and variant CG56381-02 was assessed using the primer-probe sets Ag2916 and Ag2921, described in Tables IA and IB. Results of the RTQ-PCR runs are shown in Tables IC, ID and IE.

TABLE IA

Probe Name Ag2916

| Primers | Sequences | Length | Start Position |
|---|---|---|---|
| Forward | 5'-cattgaggtcttcacccactac-3' (SEQ ID NO: 380) | 22 | 1898 |

TABLE IA-continued

Probe Name Ag2916

| Primers | Sequences | Length | Start Position |
|---|---|---|---|
| Probe | TET-5'-ctcctcactctcaatggctccaaggt-3'-TAMRA (SEQ ID NO: 381) | 26 | 1923 |
| Reverse | 5'-gtttgtgtcctcagacagaag-3' (SEQ ID NO: 382) | 22 | 1970 |

TABLE IB

Probe Name Ag2921

| Primers | Sequences | Length | Start Position |
|---|---|---|---|
| Forward | 5'-cattgaggtcttcacccactac-3' (SEQ ID NO: 383) | 22 | 1898 |
| Probe | TET-5'-ctcctcactctcaatggctccaaggt-3'-TAMRA (SEQ ID NO: 384) | 26 | 1923 |
| Reverse | 5'-gtttgtgtcctcagacagaag-3' (SEQ ID NO: 385) | 22 | 1970 |

TABLE IC

Panel 1.3D

| Tissue Name | Rel. Exp. (%) Ag2916, Run 167649470 | Rel. Exp. (%) Ag2921, Run 167862040 |
|---|---|---|
| Liver adenocarcinoma | 31.6 | 23.7 |
| Pancreas | 1.8 | 1.4 |
| Pancreatic ca. CAPAN 2 | 100.0 | 100.0 |
| Adrenal gland | 0.4 | 0.2 |
| Thyroid | 2.2 | 0.7 |
| Salivary gland | 1.7 | 0.9 |
| Pituitary gland | 0.5 | 0.1 |
| Brain (fetal) | 0.3 | 0.1 |
| Brain (whole) | 0.3 | 0.2 |
| Brain (amygdala) | 0.0 | 0.3 |
| Brain (cerebellum) | 0.7 | 0.3 |
| Brain (hippocampus) | 0.1 | 0.2 |
| Brain (substantia nigra) | 0.4 | 0.2 |
| Brain (thalamus) | 0.5 | 0.1 |
| Cerebral Cortex | 0.1 | 0.1 |
| Spinal cord | 0.3 | 0.2 |
| glio/astro U87-MG | 0.4 | 0.1 |
| glio/astro U-118-MG | 0.5 | 0.2 |
| astrocytoma SW1783 | 0.3 | 0.2 |
| neuro*; met SK-N-AS | 0.1 | 0.2 |
| astrocytoma SF-539 | 8.9 | 8.2 |
| astrocytoma SNB-75 | 2.1 | 1.8 |
| glioma SNB-19 | 3.6 | 2.7 |
| glioma U251 | 29.9 | 28.5 |
| glioma SF-295 | 0.4 | 0.4 |
| Heart (fetal) | 0.9 | 0.4 |
| Heart | 0.4 | 0.2 |
| Skeletal muscle (fetal) | 4.9 | 2.9 |
| Skeletal muscle | 2.5 | 3.2 |
| Bone marrow | 0.1 | 0.0 |
| Thymus | 0.9 | 0.3 |
| Spleen | 0.2 | 0.2 |
| Lymph node | 0.4 | 0.5 |
| Colorectal | 0.9 | 0.7 |
| Stomach | 0.4 | 0.5 |
| Small intestine | 0.9 | 1.4 |
| Colon ca. SW480 | 5.3 | 3.5 |
| Colon ca.* SW620 (SW480 met) | 5.9 | 5.0 |
| Colon ca. HT29 | 0.8 | 0.7 |
| Colon ca. HCT-116 | 0.3 | 0.3 |
| Colon ca. CaCo-2 | 0.8 | 0.7 |

TABLE IC-continued

Panel 1.3D

| Tissue Name | Rel. Exp. (%) Ag2916, Run 167649470 | Rel. Exp. (%) Ag2921, Run 167862040 |
|---|---|---|
| Colon ca. tissue (ODO3866) | 0.2 | 0.1 |
| Colon ca. HCC-2998 | 0.3 | 0.3 |
| Gastric ca.* (liver met) NCI-N87 | 43.5 | 37.6 |
| Bladder | 2.1 | 1.6 |
| Trachea | 2.0 | 1.5 |
| Kidney | 1.6 | 0.9 |
| Kidney (fetal) | 4.5 | 3.2 |
| Renal ca 786-0 | 0.3 | 0.2 |
| Renal ca. A498 | 0.1 | 0.1 |
| Renal ca. RXF 393 | 8.8 | 6.4 |
| Renal ca. ACHN | 25.3 | 16.0 |
| Renal ca. UO-31 | 3.6 | 3.2 |
| Renal ca. TK-10 | 0.6 | 0.4 |
| Liver | 0.4 | 0.3 |
| Liver (fetal) | 6.4 | 6.1 |
| Liver ca. (hepatoblast) HepG2 | 5.1 | 3.7 |
| Lung | 1.3 | 0.6 |
| Lung (fetal) | 0.9 | 0.4 |
| Lung ca. (small cell) LX-1 | 0.7 | 0.7 |
| Lung ca. (small cell) NCI-H69 | 0.4 | 0.1 |
| Lung ca. (s. cell var.) SHP-77 | 2.6 | 2.1 |
| Lung ca. (large cell) NCI-H460 | 6.0 | 0.1 |
| Lung ca. (non-sm. cell) A549 | 2.0 | 1.2 |
| Lung ca. (non-s. cell) NCI-H23 | 0.9 | 0.5 |
| Lung ca. (non-s. cell) HOP-62 | 2.8 | 1.7 |
| Lung ca. (non-s. cl) NCI-H522 | 0.2 | 0.2 |
| Lung ca. (squam.) SW 900 | 3.6 | 2.4 |
| Lung ca. (squam.) NCI-H596 | 1.9 | 1.2 |
| Mammary gland | 5.1 | 3.7 |
| Breast ca.* (pl. ef) MCF-7 | 0.7 | 0.3 |
| Breast ca.* (pl. ef) MDA-MB-231 | 9.0 | 6.0 |
| Breast ca.* (pl. ef) T47D | 0.6 | 1.1 |
| Breast ca. BT-549 | 0.1 | 0.1 |
| Breast ca. MDA-N | 1.1 | 0.8 |
| Ovary | 2.0 | 1.4 |
| Ovarian ca. OVCAR-3 | 0.3 | 0.3 |
| Ovarian ca. OVCAR-4 | 0.7 | 0.5 |
| Ovarian ca. OVCAR-5 | 27.5 | 18.7 |
| Ovarian ca. OVCAR-8 | 0.4 | 0.2 |
| Ovarian ca. IGROV-1 | 0.2 | 0.2 |
| Ovarian ca.* (ascites) SK-OV-3 | 2.6 | 2.1 |
| Uterus | 2.3 | 1.4 |
| Placenta | 0.2 | 0.1 |
| Prostate | 0.6 | 0.3 |
| Prostate ca.* (bone met) PC-3 | 2.8 | 1.4 |
| Testis | 1.8 | 2.7 |
| Melanoma Hs688(A).T | 2.7 | 2.4 |
| Melanoma* (met) Hs688(B).T | 3.1 | 2.7 |
| Melanoma UACC-62 | 0.3 | 0.4 |
| Melanoma M14 | 1.0 | 1.0 |
| Melanoma LOX IMVI | 0.5 | 0.4 |
| Melanoma* (met) SK-MEL-5 | 0.3 | 0.2 |
| Adipose | 1.5 | 1.3 |

TABLE ID

Panel 2.2

| Tissue Name | Rel. Exp. (%) Ag2916, Run 175119162 | Rel. Exp. (%) Ag2921, Run 175119364 |
|---|---|---|
| Normal Colon | 15.4 | 13.1 |
| Colon cancer (OD06064) | 5.9 | 1.7 |
| Colon Margin (OD06064) | 5.8 | 5.7 |
| Colon cancer (OD06159) | 1.1 | 0.0 |
| Colon Margin (OD06159) | 15.6 | 8.3 |
| Colon cancer (OD06297-04) | 0.9 | 1.8 |
| Colon Margin (OD06297-015) | 22.8 | 15.2 |
| CC Gr. 2 ascend colon (ODO3921) | 0.3 | 0.9 |

TABLE ID-continued

Panel 2.2

| Tissue Name | Rel. Exp. (%) Ag2916, Run 175119162 | Rel. Exp. (%) Ag2921, Run 175119364 |
|---|---|---|
| CC Margin (OD03921) | 2.6 | 6.6 |
| Colon cancer metastasis (OD06104) | 0.9 | 1.0 |
| Lung Margin (OD06104) | 2.1 | 2.1 |
| Colon mets to lung (OD04451-01) | 4.5 | 1.7 |
| Lung Margin (OD04451-02) | 11.0 | 4.7 |
| Normal Prostate | 6.0 | 6.1 |
| Prostate Cancer (OD04410) | 5.1 | 4.7 |
| Prostate Margin (OD04410) | 5.6 | 7.3 |
| Normal Ovary | 20.3 | 24.0 |
| Ovarian cancer (OD06283-03) | 3.7 | 2.6 |
| Ovarian Margin (OD06283-07) | 6.1 | 3.6 |
| Ovarian Cancer 064008 | 18.0 | 30.1 |
| Ovarian cancer (OD06145) | 0.7 | 3.2 |
| Ovarian Margin (OD06145) | 19.1 | 30.1 |
| Ovarian cancer (OD06455-03) | 2.2 | 1.3 |
| Ovarian Margin (OD06455-07) | 9.5 | 7.0 |
| Normal Lung | 7.7 | 8.2 |
| Invasive poor diff. lung adeno (OD04945-01) | 0.9 | 0.0 |
| Lung Margin (OD04945-03) | 11.3 | 10.4 |
| Lung Malignant Cancer (OD03126) | 5.0 | 1.2 |
| Lung Margin (OD03126) | 2.6 | 1.5 |
| Lung Cancer (OD05014A) | 5.0 | 2.3 |
| Lung Margin (OD05014B) | 12.6 | 3.4 |
| Lung cancer (OD06081) | 13.7 | 6.6 |
| Lung Margin (OD06081) | 4.6 | 6.5 |
| Lung Cancer (OD04237-01) | 3.4 | 2.3 |
| Lung Margin (OD04237-02) | 18.4 | 8.1 |
| Ocular Melanoma Metastasis | 12.9 | 14.2 |
| Ocular Melanoma Margin (Liver) | 13.7 | 11.6 |
| Melanoma Metastasis | 1.1 | 1.4 |
| Melanoma Margin (Lung) | 12.4 | 9.6 |
| Normal Kidney | 9.8 | 5.3 |
| Kidney Ca, Nuclear grade 2 (OD04338) | 45.1 | 33.4 |
| Kidney Margin (OD04338) | 4.9 | 12.2 |
| Kidney Ca Nuclear grade 1/2 (OD04339) | 43.5 | 29.1 |
| Kidney Margin (OD04339) | 6.9 | 4.6 |
| Kidney Ca, Clear cell type (OD04340) | 22.4 | 11.5 |
| Kidney Margin (OD04340) | 24.8 | 14.0 |
| Kidney Ca, Nuclear grade 3 (OD04348) | 3.6 | 2.0 |
| Kidney Margin (OD04348) | 79.6 | 59.0 |
| Kidney malignant cancer (OD06204B) | 3.6 | 5.1 |
| Kidney normal adjacent tissue (OD06204E) | 18.8 | 9.9 |
| Kidney Cancer (OD04450-01) | 16.8 | 10.7 |
| Kidney Margin (OD04450-03) | 12.9 | 12.9 |
| Kidney Cancer 8120613 | 0.0 | 0.8 |
| Kidney Margin 8120614 | 12.8 | 3.9 |
| Kidney Cancer 9010320 | 3.7 | 1.7 |
| Kidney Margin 9010321 | 10.5 | 8.4 |
| Kidney Cancer 8120607 | 6.9 | 8.7 |
| Kidney Margin 8120608 | 7.4 | 5.1 |
| Normal Uterus | 51.4 | 37.4 |
| Uterine Cancer 064011 | 5.4 | 8.8 |
| Normal Thyroid | 2.9 | 6.5 |
| Thyroid Cancer 064010 | 8.6 | 5.5 |
| Thyroid Cancer A302152 | 7.4 | 15.0 |
| Thyroid Margin A302153 | 6.1 | 1.0 |
| Normal Breast | 35.1 | 28.1 |
| Breast Cancer (OD04566) | 0.0 | 0.0 |
| Breast Cancer 1024 | 18.3 | 15.1 |
| Breast Cancer (OD04590-01) | 6.5 | 4.8 |
| Breast Cancer Mets (OD04590-03) | 7.0 | 12.1 |
| Breast Cancer Metastasis (OD04655-05) | 3.0 | 3.4 |
| Breast Cancer 064006 | 2.1 | 3.3 |
| Breast Cancer 9100266 | 6.8 | 5.6 |
| Breast Margin 9100265 | 5.9 | 5.8 |
| Breast Cancer A209073 | 8.5 | 3.9 |
| Breast Margin A2090734 | 21.9 | 15.0 |
| Breast cancer (OD06083) | 11.3 | 8.1 |
| Breast cancer node metastasis (OD06083) | 1.7 | 9.3 |
| Normal Liver | 5.6 | 8.4 |
| Liver Cancer 1026 | 59.9 | 48.0 |
| Liver Cancer 1025 | 11.3 | 15.5 |
| Liver Cancer 6004-T | 7.9 | 9.9 |
| Liver Tissue 6004-N | 2.6 | 2.7 |
| Liver Cancer 6005-T | 100.0 | 100.0 |
| Liver Tissue 6005-N | 15.0 | 8.4 |
| Liver Cancer 064003 | 7.1 | 12.4 |
| Normal Bladder | 5.6 | 8.5 |
| Bladder Cancer 1023 | 1.6 | 0.0 |
| Bladder Cancer A302173 | 2.0 | 3.4 |
| Normal Stomach | 13.4 | 15.6 |
| Gastric Cancer 9060397 | 1.2 | 0.5 |
| Stomach Margin 9060396 | 1.0 | 3.0 |
| Gastric Cancer 9060395 | 12.2 | 5.8 |
| Stomach Margin 9060394 | 13.3 | 7.5 |
| Gastric Cancer 064005 | 5.2 | 3.1 |

TABLE IE

Panel 4D

| Tissue Name | Rel. Exp. (%) Ag2916, Run 164310645 | Rel. Exp. (%) Ag2921, Run 164310646 |
|---|---|---|
| Secondary Th1 act | 1.3 | 0.7 |
| Secondary Th2 act | 2.7 | 1.5 |
| Secondary Tr1 act | 1.2 | 1.5 |
| Secondary Th1 rest | 0.8 | 0.4 |
| Secondary Th2 rest | 0.8 | 1.1 |
| Secondary Tr1 rest | 0.8 | 0.6 |
| Primary Th1 act | 3.5 | 1.3 |
| Primary Th2 act | 1.0 | 1.3 |
| Primary Tr1 act | 3.2 | 2.3 |
| Primary Th1 rest | 4.5 | 3.2 |
| Primary Th2 rest | 2.3 | 1.5 |
| Primary Tr1 rest | 1.5 | 2.3 |
| CD45RA CD4 lymphocyte act | 2.4 | 3.0 |
| CD45RO CD4 lymphocyte act | 1.4 | 1.6 |
| CD8 lymphocyte act | 0.7 | 0.7 |
| Secondary CD8 lymphocyte rest | 1.0 | 0.7 |
| Secondary CD8 lymphocyte act | 0.9 | 0.7 |
| CD4 lymphocyte none | 1.2 | 0.9 |
| 2ry Th1/Th2/Tr1_anti-CD95 CH11 | 1.2 | 1.4 |
| LAK cells rest | 1.6 | 1.7 |
| LAK cells IL-2 | 1.3 | 2.0 |
| LAK cells IL-2 + IL-12 | 1.3 | 1.4 |
| LAK cells IL-2 + IFN gamma | 4.4 | 3.0 |
| LAK cells IL-2 + IL-18 | 1.7 | 1.4 |
| LAK cells PMA/ionomycin | 0.4 | 0.8 |
| NK Cells IL-2 rest | 1.6 | 1.1 |
| Two Way MLR 3 day | 2.5 | 2.1 |
| Two Way MLR 5 day | 1.2 | 1.0 |
| Two Way MLR 7 day | 1.4 | 0.6 |
| PBMC rest | 0.6 | 1.2 |
| PBMC PWM | 6.7 | 2.5 |
| PBMC PHA-L | 0.8 | 2.1 |
| Ramos (B cell) none | 2.0 | 2.4 |
| Ramos (B cell) ionomycin | 5.8 | 4.9 |
| B lymphocytes PWM | 2.5 | 2.6 |
| B lymphocytes CD40L and IL-4 | 2.2 | 2.4 |

TABLE IE-continued

Panel 4D

| Tissue Name | Rel. Exp. (%) Ag2916, Run 164310645 | Rel. Exp. (%) Ag2921, Run 164310646 |
|---|---|---|
| EOL-1 dbcAMP | 0.7 | 1.1 |
| EOL-1 dbcAMP PMA/ionomycin | 2.4 | 1.4 |
| Dendritic cells none | 1.9 | 0.7 |
| Dendritic cells LPS | 0.7 | 1.3 |
| Dendritic cells anti-CD40 | 1.3 | 0.8 |
| Monocytes rest | 2.0 | 1.7 |
| Monocytes LPS | 2.3 | 1.7 |
| Macrophages rest | 0.9 | 1.4 |
| Macrophages LPS | 0.8 | 0.5 |
| HUVEC none | 0.8 | 1.4 |
| HUVEC starved | 2.6 | 2.4 |
| HUVEC IL-1beta | 0.3 | 1.7 |
| HUVEC IFN gamma | 0.8 | 0.8 |
| HUVEC TNF alpha + IFN gamma | 0.5 | 0.7 |
| HUVEC TNF alpha + IL4 | 0.8 | 0.8 |
| HUVEC IL-11 | 0.9 | 0.8 |
| Lung Microvascular EC none | 1.6 | 3.3 |
| Lung Microvascular EC TNFalpha + IL-1beta | 1.6 | 1.5 |
| Microvascular Dermal EC none | 1.2 | 0.6 |
| Microsvascular Dermal EC TNFalpha + IL-1beta | 0.7 | 0.5 |
| Bronchial epithelium TNFalpha + IL1beta | 1.6 | 1.3 |
| Small airway epithelium none | 0.9 | 1.0 |
| Small airway epithelium TNFalpha + IL-1beta | 2.5 | 3.4 |
| Coronery artery SMC rest | 9.7 | 8.0 |
| Coronery artery SMC TNFalpha + IL-1beta | 4.5 | 3.1 |
| Astrocytes rest | 12.6 | 11.7 |
| Astrocytes TNFalpha + IL-1beta | 49.0 | 30.8 |
| KU-812 (Basophil) rest | 0.5 | 0.6 |
| KU-812 (Basophil) PMA/ionomycin | 1.1 | 1.3 |
| CCD1106 (Keratinocytes) none | 1.3 | 0.7 |
| CCD1106 (Keratinocytes) TNFalpha + IL-1beta | 0.4 | 0.8 |
| Liver cirrhosis | 2.6 | 2.4 |
| Lupus kidney | 1.0 | 1.7 |
| NCI-H292 none | 1.5 | 2.8 |
| NCI-H292 IL-4 | 8.0 | 7.5 |
| NCI-H292 IL-9 | 1.6 | 4.2 |
| NCI-H292 IL-13 | 5.3 | 3.1 |
| NCI-H292 IFN gamma | 0.6 | 1.3 |
| HPAEC none | 0.8 | 0.4 |
| HPAEC TNF alpha + IL-1beta | 0.5 | 0.6 |
| Lung fibroblast none | 17.7 | 15.4 |
| Lung fibroblast TNF alpha + IL-1beta | 4.2 | 3.3 |
| Lung fibroblast IL-4 | 20.6 | 11.7 |
| Lung fibroblast IL-9 | 25.5 | 17.8 |
| Lung fibroblast IL-13 | 9.0 | 7.7 |
| Lung fibroblast IFN gamma | 15.8 | 13.2 |
| Dermal fibroblast CCD1070 rest | 14.2 | 10.1 |
| Dermal fibroblast CCD1070 TNF alpha | 12.2 | 15.4 |
| Dermal fibroblast CCD1070 IL-1beta | 8.2 | 4.7 |
| Dermal fibroblast IFN gamma | 100.0 | 100.0 |
| Dermal fibroblast IL-4 | 55.5 | 38.2 |
| IBD Colitis 2 | 0.0 | 0.1 |
| IBD Crohn's | 0.4 | 0.2 |
| Colon | 2.7 | 1.8 |
| Lung | 4.6 | 2.4 |
| Thymus | 5.6 | 2.8 |
| Kidney | 3.6 | 2.6 |

Panel 1.3D Summary: Ag2916/Ag2921 The expression of the CG56381-01 gene was assessed in two independent runs with the same probe and primer set, with good concordance between the runs. Highest expression is seen in a pancreatic cancer cell line CAPAN2 (CTs=26). Additionally, moderate expression is seen in a liver cell line as well as brain, colon, gastric, renal, lung, ovarian cancer cell lines as well as some melanoma cell lines. Thus, the expression of this gene might be associated with these forms of cancer and therapeutic modulation of this gene might be of use in the treatment of these cancers.

REFERENCES

Csiszar K.; Lysyl oxidases: a novel multifunctional amine oxidase family. Prog Nucleic Acid Res Mol Biol 2001; 70:1–32.

Lysyl oxidase (LOX), a copper-containing amine oxidase, belongs to a heterogeneous family of enzymes that oxidize primary amine substrates to reactive aldehydes. LOX has been traditionally known for one function, the extracellular catalysis of lysine-derived cross-links in fibrillar collagens and elastin. More recently, diverse roles have been attributed to lysyl oxidase and these novel activities cover a spectrum of diverse biological functions such as developmental regulation, tumor suppression, cell motility, and cellular senescence. Lysyl oxidase has also been shown to have both intracellular and intranuclear locations. The multifunctional properties of lysyl oxidase (LOX) and our recent discovery of three novel members of this amine oxidase family, LOX-like (LOXL), LOXL2, and LOXL3, indicate the possibility that these varied functions are performed in both intracellular and extracellular environments by individual novel members of the LOX amine-oxidase family. Structural similarities of the highly conserved copper-binding and lysyl-tyrosylquinone cofactor sites among the LOX and LOX-like proteins may result in similar amine oxidase activities. However, specific novel functions, such as a potential role in cell adhesion and cell growth control, will be determined by other, conserved domains such as the cytokine receptor-like domain that is shared by all LOXs and by multiple scavenger receptor cysteine-rich (SRCR) domains present in LOXL2 and LOXL3. Furthermore, these functions may be carried out in a temporally and spatially regulated fashion.

PMID: 11642359

Panel 2.2 Summary: Ag2916/Ag2921 Two experiments with the same probe and primer set produce results that are in excellent agreement, with highest expression of the CG56381-01 gene in liver cancer (CTs=30). In addition, liver cancers express this gene at a higher level than the normal adjacent liver tissue. Conversely normal ovary and colon tissue express higher level of this gene than the adjacent tumor tissue. Thus, expresseion of this gene can be used as a diagnostic marker for the presence of these cancers. Furthermore, therapetic modulation of this gene using antibodies and small molecule may be useful in the treatment of liver cancer.

Panel 4D Summary: Ag2916/Ag2921 Two experiments with the same probe and primer set produce results that are in excellent agreement, with highest expression of the CG56381-01 gene dermal fibroblasts treated with the proinflammatory cytokines IL-4 and gamma interferon (CTs=26). The transcript, which encodes a putative lysyl oxidase, is expressed at low levels in most tissues in the panel. This enzyme is associated with dermal fibroblasts and is increased in scleroderma. Thus, the transcript or the protein it encodes could be used to identify activated dermal fibroblasts and as a diagnositic reagent for scleroderma. In addition, therapeutics designed with the protein encoded by this transcript could be important for the treatment of scleroderma and other skin diseases such as psoriasis.

REFERENCES

Chanoki M, Ishii M, Kobayashi H, Fushida H, Yashiro N, Hamada T, Ooshima A. Increased expression of lysyl oxidase in skin with scleroderma. Br J Dermatol 1995 November; 133(5):710–5

Lysyl oxidase initiates cross-linkage of collagen and elastin by catalysing the formation of a lysine-derived aldehyde. In order to study cross-linking in scleroderma, we used monoclonal antibodies to lysyl oxidase to determine the localization of this enzyme in systemic and localized scleroderma, and compared the distributions obtained with that in normal skin. Using an indirect immunofluorescent antibody method and an avidin-biotinylated enzyme complex method, 11 cases of diffuse type of systemic scleroderma and seven cases of localized scleroderma were studied. In the oedematous stage of systemic scleroderma, intracellular and extracellular lysyl oxidase were remarkably increased in the dermis, particularly in groups around blood vessels. In the sclerotic stage of systemic scleroderma, lysyl oxidase was detected intracellularly in fibroblasts and extracellularly among collagen bundles between the lower dermis and the subcutaneous fat tissue. In localized scleroderma, a marked increase in lysyl oxidase was observed in mononuclear cells and fibroblasts near blood vessels in the lower dermis and in the subcutaneous fat tissue, in addition to the extracellular deposits between collagen bundles. The increase in lysyl oxidase in localized scleroderma was much more common than in the oedematous stage of systemic scleroderma. These findings indicated that intracellular and extracellular expression of lysyl oxidase expression was greater in sclerodermatous skin than in normal skin.

NOV12a and NOV12b: CG56436-01 and CG56436-02: Phosphatase Like

Expression of gene CG56436-01 and variant CG56436-02 was assessed using the primer-probe set Ag2927, described in Table JA. Results of the RTQ-PCR runs are shown in Tables JB and JC.

TABLE JA

Probe Name Ag2927

| Primers | Sequences | Length | Start Position |
|---|---|---|---|
| Forward | 5'-ctatctagggacggcaggat-3' (SEQ ID NO:386) | 20 | 137 |
| Probe | TET-5'-ctcctgaccttcgacttcgacgaga-3'-TAMRA (SEQ ID NO:387) | 25 | 182 |
| Reverse | 5'-gctgttttcgtccacgatag-3' (SEQ ID NO:388) | 20 | 207 |

TABLE JB

Panel 1.3D

| Tissue Name | Rel. Exp. (%) Ag2927, Run 167862124 |
|---|---|
| Liver adenocarcinoma | 1.1 |
| Pancreas | 0.1 |
| Pancreatic ca. CAPAN 2 | 0.1 |
| Adrenal gland | 0.3 |
| Thyroid | 0.0 |
| Salivary gland | 0.1 |
| Pituitary gland | 0.1 |

TABLE JB-continued

Panel 1.3D

| Tissue Name | Rel. Exp. (%) Ag2927, Run 167862124 |
|---|---|
| Brain (fetal) | 0.0 |
| Brain (whole) | 0.9 |
| Brain (amygdala) | 0.0 |
| Brain (cerebellum) | 0.5 |
| Brain (hippocampus) | 0.1 |
| Brain (substantia nigra) | 0.6 |
| Brain (thalamus) | 1.6 |
| Cerebral Cortex | 1.5 |
| Spinal cord | 0.4 |
| glio/astro U87-MG | 0.4 |
| glio/astro U-118-MG | 0.2 |
| astrocytoma SW1783 | 0.4 |
| neuro*; met SK-N-AS | 0.0 |
| astrocytoma SF-539 | 0.0 |
| astrocytoma SNB-75 | 0.3 |
| glioma SNB-19 | 0.0 |
| glioma U251 | 0.0 |
| glioma SF-295 | 1.7 |
| Heart (fetal) | 100.0 |
| Heart | 0.1 |
| Skeletal muscle (fetal) | 1.3 |
| Skeletal muscle | 0.2 |
| Bone marrow | 6.6 |
| Thymus | 0.3 |
| Spleen | 0.9 |
| Lymph node | 0.7 |
| Colorectal | 0.0 |
| Stomach | 0.2 |
| Small intestine | 0.3 |
| Colon ca. SW480 | 0.1 |
| Colon ca.* SW620 (SW480 met) | 0.0 |
| Colon ca. HT29 | 0.0 |
| Colon ca. HCT-116 | 0.5 |
| Colon ca. CaCo-2 | 0.8 |
| Colon ca. tissue (ODO3866) | 0.1 |
| Colon ca. HCC-2998 | 0.0 |
| Gastric ca.* (liver met) NCI-N87 | 0.0 |
| Bladder | 0.2 |
| Trachea | 0.0 |
| Kidney | 0.3 |
| Kidney (fetal) | 11.0 |
| Renal ca. 786-0 | 0.1 |
| Renal ca. A498 | 0.4 |
| Renal ca. RXF 393 | 0.2 |
| Renal ca. ACHN | 0.0 |
| Renal ca. UO-31 | 0.0 |
| Renal ca. TK-10 | 0.4 |
| Liver | 0.1 |
| Liver (fetal) | 29.1 |
| Liver ca. (hepatoblast) HepG2 | 0.0 |
| Lung | 0.6 |
| Lung (fetal) | 0.3 |
| Lung ca. (small cell) LX-1 | 0.1 |
| Lung ca. (small cell) NCI-H69 | 0.0 |
| Lung ca. (s. cell var.) SHP-77 | 0.1 |
| Lung ca. (large cell) NCI-H460 | 0.0 |
| Lung ca. (non-sm. cell) A549 | 0.2 |
| Lung ca. (non-s. cell) NCI-H23 | 0.1 |
| Lung ca. (non-s. cell) HOP-62 | 0.0 |
| Lung ca. (non-s. cl) NCI-H522 | 0.1 |
| Lung ca. (squam.) SW 900 | 0.2 |

TABLE JB-continued

Panel 1.3D

| Tissue Name | Rel. Exp. (%) Ag2927, Run 167862124 |
|---|---|
| Lung ca. (squam.) NCI-H596 | 0.0 |
| Mammary gland | 0.2 |
| Breast ca.* (pl. ef) MCF-7 | 0.0 |
| Breast ca.* (pl. ef) MDA-MB-231 | 0.0 |
| Breast ca.* (pl. ef) T47D | 0.0 |
| Breast ca. BT-549 | 0.0 |
| Breast ca. MDA-N | 0.0 |
| Ovary | 0.1 |
| Ovarian ca. OVCAR-3 | 0.1 |
| Ovarian ca. OVCAR-4 | 3.8 |
| Ovarian ca. OVCAR-5 | 0.6 |
| Ovarian ca. OVCAR-8 | 0.3 |
| Ovarian ca. IGROV-1 | 0.0 |
| Ovarian ca.* (ascites) SK-OV-3 | 0.5 |
| Uterus | 0.2 |
| Placenta | 0.4 |
| Prostate | 0.4 |
| Prostate ca.* (bone met) PC-3 | 1.5 |
| Testis | 6.6 |
| Melanoma Hs688(A).T | 0.1 |
| Melanoma* (met) Hs688(B).T | 0.0 |
| Melanoma UACC-62 | 0.3 |
| Melanoma M14 | 0.0 |
| Melanoma LOX IMVI | 0.0 |
| Melanoma* (met) SK-MEL-5 | 0.3 |
| Adipose | 0.0 |

TABLE JC

Panel 4D

| Tissue Name | Rel. Exp. (%) Ag2927, Run 164306316 |
|---|---|
| Secondary Th1 act | 1.5 |
| Secondary Th2 act | 5.4 |
| Secondary Tr1 act | 9.0 |
| Secondary Th1 rest | 4.6 |
| Secondary Th2 rest | 9.0 |
| Secondary Tr1 rest | 4.5 |
| Primary Th1 act | 2.1 |
| Primary Th2 act | 2.0 |
| Primary Tr1 act | 2.1 |
| Primary Th1 rest | 9.7 |
| Primary Th2 rest | 11.8 |
| Primary Tr1 rest | 7.3 |
| CD45RA CD4 lymphocyte act | 1.7 |
| CD45RO CD4 lymphocyte act | 2.0 |
| CD8 lymphocyte act | 7.8 |
| Secondary CD8 lymphocyte rest | 7.1 |
| Secondary CD8 lymphocyte act | 5.8 |
| CD4 lymphocyte none | 1.6 |
| 2ry Th1/Th2/Tr1_anti-CD95 CH11 | 3.6 |
| LAK cells rest | 17.4 |
| LAK cells IL-2 | 13.3 |

TABLE JC-continued

Panel 4D

| Tissue Name | Rel. Exp. (%) Ag2927, Run 164306316 |
|---|---|
| LAK cells IL-2 + IL-12 | 4.3 |
| LAK cells IL-2 + IFN gamma | 3.4 |
| LAK cells IL-2 + IL-18 | 8.0 |
| LAK cells PMA/ionomycin | 4.6 |
| NK Cells IL-2 rest | 24.5 |
| Two Way MLR 3 day | 6.6 |
| Two Way MLR 5 day | 2.2 |
| Two Way MLR 7 day | 8.7 |
| PBMC rest | 12.6 |
| PBMC PWM | 4.5 |
| PBMC PHA-L | 6.4 |
| Ramos (B cell) none | 3.3 |
| Ramos (B cell) ionomycin | 8.0 |
| B lymphocytes PWM | 3.1 |
| B lymphocytes CD40L and IL-4 | 4.3 |
| EOL-1 dbcAMP | 14.3 |
| EOL-1 dbcAMP PMA/ionomycin | 43.5 |
| Dendritic cells none | 22.2 |
| Dendritic cells LPS | 54.0 |
| Dendritic cells anti-CD40 | 100.0 |
| Monocytes rest | 29.5 |
| Monocytes LPS | 0.8 |
| Macrophages rest | 18.0 |
| Macrophages LPS | 2.3 |
| HUVEC none | 4.7 |
| HUVEC starved | 3.3 |
| HUVEC IL-1 beta | 3.6 |
| HUVEC IFN gamma | 7.7 |
| HUVEC TNF alpha + IFN gamma | 5.4 |
| HUVEC TNF alpha + IL4 | 0.6 |
| HUVEC IL-11 | 3.5 |
| Lung Microvascular EC none | 6.9 |
| Lung Microvascular EC TNF alpha + IL-1 beta | 2.7 |
| Microvascular Dermal EC none | 4.2 |
| Microvasular Dermal EC TNF alpha + IL-1 beta | 4.8 |
| Bronchial epithelium TNF alpha + IL1 beta | 0.0 |
| Small airway epithelium none | 0.9 |
| Small airway epithelium TNF alpha + IL-1 beta | 0.0 |
| Coronery artery SMC rest | 0.0 |
| Coronery artery SMC TNF alpha + IL-1 beta | 0.0 |
| Astrocytes rest | 0.0 |
| Astrocytes TNF alpha + IL-1 beta | 1.0 |
| KU-812 (Basophil) rest | 5.5 |
| KU-812 (Basophil) PMA/ionomycin | 7.8 |
| CCD1106 (Keratinocytes) none | 0.0 |
| CCD1106 (Keratinocytes) TNF alpha + IL-1 beta | 0.0 |
| Liver cirrhosis | 6.3 |
| Lupus kidney | 0.9 |
| NCI-H292 none | 0.0 |
| NCI-H292 IL-4 | 0.0 |
| NCI-H292 IL-9 | 0.0 |
| NCI-H292 IL-13 | 0.0 |
| NCI-H292 IFN gamma | 0.0 |
| HPAEC none | 2.1 |

TABLE JC-continued

Panel 4D

| Tissue Name | Rel. Exp. (%) Ag2927, Run 164306316 |
|---|---|
| HPAEC TNF alpha + IL-1 beta | 5.4 |
| Lung fibroblast none | 0.9 |
| Lung fibroblast TNF alpha + IL-1 beta | 0.0 |
| Lung fibroblast IL-4 | 1.0 |
| Lung fibroblast IL-9 | 0.0 |
| Lung fibroblast IL-13 | 2.4 |
| Lung fibroblast IFN gamma | 0.0 |
| Dermal fibroblast CCD1070 rest | 2.2 |
| Dermal fibroblast CCD1070 TNF alpha | 21.3 |
| Dermal fibroblast CCD1070 IL-1 beta | 0.4 |
| Dermal fibroblast IFN gamma | 0.0 |
| Dermal fibroblast IL-4 | 0.0 |
| IBD Colitis 2 | 2.9 |
| IBD Crohn's | 1.8 |
| Colon | 13.2 |
| Lung | 19.5 |
| Thymus | 2.4 |
| Kidney | 3.4 |

Panel 1.3D Summary: Ag2927 Highest expression of the CG56436-01 gene is seen in the fetal heart (CT=27). Significant levels of expression are also seen in fetal liver and kidney (CTs=2930). Furthermore, the levels of expression in fetal tissue are much higher than the expression in their adult counterparts. This gene encodes a putative phosphatase and could potentially be used to differentiate between fetal and adult liver, kidney and heart tissue. Furthermore, the higher levels of expression in fetal tissue suggests that this gene may be involved in regulating phosphorylation states in proteins involved in cell growth and proliferation. This conclusion is further supported by the low expression in the tissues originating in the central nervous system, which are primarily composed of post-mitotic cells. Thus, this gene play a role in the cell cycle or possibly in the inhibition of cell differentiation. Therefore, this gene may be of use in stem cell research or therapy intended to control the fate of the stem cells.

Panel 4D Summary: Ag2927 The CG56436-01 transcript is highly expressed in dendritic cells (DC) and is upregulated in response to LPS or CD40 (CT=30). This gene, which encodes a phosphatase homolog, is also expressed in activated EOL cells and TNFalpha induced dermal fibroblasts. Thus, this putative phosphatase may be involved in signalling important in cellular differentiation. This is consistant with the low expression in monocytes, monocytes differentiated into dendritic cells, and monocytes differentiated into macrophages and the upregulation of this transcript in dendritic cells after activation with CD40. Furthermore, phosphatase involvement in DC maturation has been documented (see reference). In addition, colon and lung expression of the transcript is may also result from dendritic cells present in these tissue. Therefore, therapeutic utilization of the protein encoded by this transcript may be important in immune modulation, organ/bone marrow transplantation, and the treatment of diseases where antigen presentation, a function of mature dendritic cells, plays an important role such as asthma, rheumatoid arthrtis, IBD, and psoriasis.

REFERENCES

Faries M B, Bedrosian I, Xu S, Koski G, Roros J G, Moise M A, Nguyen H Q, Engels F H, Cohen P A, Czerniecki B J. Calcium signaling inhibits interleukin-12 production and activates CD83(+) dendritic cells that induce Th2 cell development. Blood 2001 Oct. 15; 98(8):2489–97

Mature dendritic cells (DCs), in addition to providing costimulation, can define the Th1, in contrast to the Th2, nature of a T-cell response through the production of cytokines and chemokines. Because calcium signaling alone causes rapid DC maturation of both normal and transformed myeloid cells, it was evaluated whether calcium-mobilized DCs polarize T cells toward a Th1 or a Th2 phenotype. After human monocytes were cultured for 24 hours in serum-free medium and granulocyte-macrophage colony-stimulating factor to produce immature DCs, additional overnight culture with either calcium ionophore (CI) or interferon gamma (IFN-gamma), tumor necrosis factor-alpha (TNF-alpha), and soluble CD40L resulted in phenotypically mature DCs that produced interleukin-8 (IL-8) and displayed marked expression of CD80, CD86, CD40, CD54, CD83, DC-LAMP, and RelB. DCs matured by IFN-gamma, TNF-alpha, and soluble CD40L were additionally distinguished by undetectable CD4 expression, marked secretion of IL-12, IL-6, and MIP-1 beta, and preferential ability to promote Th1/Tc1 characteristics during T-cell sensitization. In contrast, DCs matured by CI treatment were distinguished by CD4 expression, modest or absent levels of IL-12, IL-6, and MIP-1 beta, and preferential ability to promote Th2/Tc2 characteristics. Calcium signaling selectively antagonized IL-12 production by mature DCs activated with IFN-gamma, TNF-alpha, and soluble CD40L. Although the activation of DCs by calcium signals is largely mediated through calcineurin phosphatase, the inhibition of IL-12 production by calcium signaling was independent of this enzyme. Naturally occurring calcium fluxes in immature DCs, therefore, negatively regulate Dc1 differentiation while promoting Dc2 characteristics and Th2/Tc2 polarization. Calcium-mobilized DCs may have clinical usefulness in treating disease states with excessive Th1/Tc1 activity, such as graft-versus-host disease or autoimmunity.

PMID: 11588047

NOV14: CG56443-01: MAST CELL FUNCTION-ASSOCIATED ANTIGEN-Like Protein

Expression of gene CG56443-01 was assessed using the primer-probe set Ag2928, described in Table KA.

TABLE KA

Probe Name Ag2928

| Primers | Sequences | Length | Start Position |
|---|---|---|---|
| Forward | 5'-ctgcttctgtcaggaaagca-3' (SEQ ID NO:389) | 20 | 519 |
| Probe | TET-5'-tttctggtcttcctgcctcggaact-3'-TAMRA (SEQ ID NO:390) | 25 | 539 |
| Reverse | 5'-tgtggtttgttattgcagtgtt-3' (SEQ ID NO:391) | 22 | 594 |

CNS_neurodegeneration_v1.0 Summary: Ag2928 Expression of the CG56443-01 gene is low/undetectable in all samples on this panel (CTs>35).

Panel 1.3D Summary: Ag2928 Expression of the CG56443-01 gene is low/undetectable in all samples on this panel (CTs>35).

Panel 4D Summary: Ag2928 Expression of the CG56443-01 gene is low/undetectable in all samples on this panel (CTs>35).

NOV15a, NOV15b, NOV15c, NOV15e, and NOV15f: CG56449-01, CG56449-02, CG56449-03, CG56449-06, and CG56449-08: MEGF6

Expression of gene CG56449-02 and variants CG56449-01, CG56449-03, CG56449-06, and CG56449-08 was assessed using the primer-probe sets Ag252, Ag252b, Ag422, Ag1513 and Ag1937, described in Tables LA, LB, LC, LD and LE. Results of the RTQ-PCR runs are shown in Tables LF, LG, LH, LI, and LJ. Please note that the probe/primer set Aga422 does not correspond to the CG56449-01, CG56449-06, and CG56449-08 variants. This does not impact the results presented below.

TABLE LA

Probe Name Ag252

| Primers | Sequences | Length | Start Position |
|---|---|---|---|
| Forward | 5'-gagctgccgcaactcttcc-3' (SEQ ID NO:392) | 19 | 1426 |
| Probe | TET-5'-cgcaactctgcctcttcctcatcgg-3' TAMRA (SEQ ID NO:393) | 25 | 1463 |
| Reverse | 5'-gacaaactctctgtgagcgtgtg-3' (SEQ ID NO:394) | 24 | 1495 |

TABLE LB

Probe Name Ag252b

| Primers | Sequences | Length | Start Position |
|---|---|---|---|
| Forward | 5'-aactcttccaggatgacgacgt-3' (SEQ ID NO:395) | 22 | 1436 |
| Probe | TET-5'-cgcaactctgcctcttcctcatcgg-3'-TAMRA (SEQ ID NO:396) | 25 | 1463 |
| Reverse | 5'-cttctctgtgagcgtgtgttcg-3' (SEQ ID NO:397) | 22 | 1491 |

TABLE LC

Probe Name Ag422

| Primers | Sequences | Length | Start Position |
|---|---|---|---|
| Forward | 5'-tgaacacccaggctcctac-3' (SEQ ID NO:398) | 20 | 518 |
| Probe | TET-5'-cggcttccggctccacactgac-3'-TAMRA (SEQ ID NO:399) | 22 | 555 |
| Reverse | 5'-taatggccaggcaggtcct-3' (SEQ ID NO:400) | 19 | 580 |

TABLE LD

Probe Name Ag1513

| Primers | Sequences | Length | Start Position |
|---|---|---|---|
| Forward | 5'-acacacgctcacagagaagttt-3' (SEQ ID NO:401) | 22 | 1494 |
| Probe | TET-5'-ctggatgactccttggccatgact-3'-TAMRA (SEQ ID NO:402) | 25 | 1522 |

TABLE LD-continued

Probe Name Ag1513

| Primers | Sequences | Length | Start Position |
|---|---|---|---|
| Reverse | 5'-ctgcagtcatcacaggtcaag-3' (SEQ ID NO:403) | 21 | 1551 |

TABLE LE

Probe Name Ag1937

| Primers | Sequences | Length | Start Position |
|---|---|---|---|
| Forward | 5'-ctgcagtcatcacaggtcaag-3' (SEQ ID NO:404) | 21 | 1551 |
| Probe | TET-5'-ccaaaggagtcatccaggcagacaaa-3'-TAMRA (SEQ ID NO:405) | 26 | 1513 |
| Reverse | 5'-gaacacacgctcacagagaag-3' (SEQ ID NO:406) | 21 | 1492 |

TABLE LF

Panel 1

| Tissue Name | Rel. Exp. (%) Ag252, Run 87586417 | Rel. Exp. (%) Ag252, Run 87588539 | Rel. Exp. (%) Ag252b, Run 91519613 | Rel. Exp. (%) Ag422, Run 90996078 |
|---|---|---|---|---|
| Endothelial cells | 0.8 | 17.3 | 9.6 | 0.4 |
| Endothelial cells (treated) | 0.6 | 5.1 | 10.6 | 0.9 |
| Pancreas | 7.9 | 13.0 | 10.8 | 1.0 |
| Pancreatic ca. CAPAN 2 | 2.3 | 10.7 | 6.1 | 0.0 |
| Adrenal gland | 0.7 | 4.3 | 8.7 | 0.1 |
| Thyroid | 0.1 | 6.6 | 5.7 | 0.1 |
| Salivary gland | 5.4 | 15.6 | 13.3 | 1.4 |
| Pituitary gland | 0.6 | 2.3 | 5.7 | 0.1 |
| Brain (fetal) | 0.0 | 1.1 | 7.7 | 0.0 |
| Brain (whole) | 0.0 | 0.1 | 1.5 | 0.0 |
| Brain (amygdala) | 0.0 | 0.2 | 4.3 | 0.0 |
| Brain (cerebellum) | 0.0 | 6.7 | 14.0 | 0.0 |
| Brain (hippocampus) | 0.0 | 0.0 | 4.1 | 0.0 |
| Brain (substantia nigra) | 0.0 | 0.3 | 5.1 | 0.0 |
| Brain (thalamus) | 0.1 | 0.5 | 3.3 | 0.0 |
| Brain (hypothalamus) | 1.2 | 1.1 | 5.3 | 0.0 |
| Spinal cord | 0.8 | 1.7 | 5.1 | 0.1 |
| glio/astro U87-MG | 0.0 | 0.0 | 0.0 | 0.0 |
| glio/astro U-118-MG | 16.2 | 33.2 | 19.1 | 19.2 |
| astrocytoma SW1783 | 19.1 | 37.4 | 19.8 | 16.3 |
| neuro*; met SK-N-AS | 0.0 | 0.0 | 0.0 | 0.0 |
| astrocytoma SF-539 | 0.9 | 3.5 | 5.1 | 0.3 |
| astrocytoma SNB-75 | 0.0 | 4.1 | 5.7 | 0.2 |
| glioma SNB-19 | 0.0 | 0.0 | 1.0 | 0.0 |
| glioma U251 | 0.0 | 0.2 | 0.9 | 0.0 |
| glioma SF-295 | 9.7 | 15.7 | 11.0 | 4.1 |

TABLE LF-continued

Panel 1

| Tissue Name | Rel. Exp. (%) Ag252, Run 87586417 | Rel. Exp. (%) Ag252, Run 87588539 | Rel. Exp. (%) Ag252b, Run 91519613 | Rel. Exp. (%) Ag422, Run 90996078 |
|---|---|---|---|---|
| Heart | 2.7 | 15.2 | 8.8 | 0.2 |
| Skeletal muscle | 0.3 | 0.3 | 3.5 | 0.0 |
| Bone marrow | 6.3 | 6.3 | 9.7 | 0.0 |
| Thymus | 25.9 | 56.6 | 39.2 | 19.3 |
| Spleen | 2.9 | 9.1 | 9.2 | 0.7 |
| Lymph node | 33.2 | 32.1 | 22.4 | 5.8 |
| Colon (ascending) | 0.0 | 0.2 | 4.9 | 0.0 |
| Stomach | 12.4 | 18.8 | 19.2 | 10.2 |
| Small intestine | 3.5 | 9.0 | 10.4 | 0.3 |
| Colon ca. SW480 | 0.0 | 0.0 | 3.7 | 0.1 |
| Colon ca.* SW620 (SW480 met) | 0.0 | 0.0 | 1.5 | 0.0 |
| Colon ca. HT29 | 0.2 | 0.9 | 3.8 | 0.0 |
| Colon ca. HCT-116 | 0.2 | 2.5 | 13.5 | 0.0 |
| Colon ca. CaCo-2 | 0.4 | 3.9 | 5.5 | 0.1 |
| Colon ca. HCT-15 | 0.2 | 4.6 | 7.6 | 0.2 |
| Colon ca. HCC-2998 | 4.3 | 11.6 | 5.1 | 0.2 |
| Gastric ca.* (liver met) NCI-N87 | 68.8 | 85.9 | 55.5 | 47.3 |
| Bladder | 10.4 | 29.3 | 12.3 | 7.9 |
| Trachea | 7.6 | 32.1 | 11.0 | 1.8 |
| Kidney | 0.8 | 8.7 | 4.9 | 0.0 |
| Kidney (fetal) | 10.3 | 32.1 | 13.2 | 1.7 |
| Renal ca. 786-0 | 10.1 | 28.1 | 13.8 | 3.9 |
| Renal ca. A498 | 32.8 | 40.9 | 24.3 | 20.0 |
| Renal ca. RXF 393 | 9.5 | 18.8 | 10.4 | 2.1 |
| Renal ca. ACHN | 0.1 | 5.8 | 5.6 | 0.2 |
| Renal ca. UO-31 | 7.6 | 17.3 | 17.7 | 6.8 |
| Renal ca. TK-10 | 1.7 | 8.8 | 8.0 | 0.3 |
| Liver | 2.7 | 12.0 | 9.1 | 0.2 |
| Liver (fetal) | 0.0 | 2.3 | 4.4 | 0.0 |
| Liver ca. (hepatoblast) HepG2 | 0.0 | 0.0 | 0.3 | 0.0 |
| Lung | 30.1 | 42.9 | 9.5 | 56.6 |
| Lung (fetal) | 29.3 | 100.0 | 42.6 | 16.3 |
| Lung ca. (small cell) LX-1 | 7.6 | 11.3 | 11.7 | 2.3 |
| Lung ca. (small cell) NCI-H69 | 0.0 | 0.0 | 0.3 | 0.0 |
| Lung ca. (s. cell var.) SHP-77 | 0.0 | 0.0 | 0.8 | 0.0 |
| Lung ca. (large cell) NCI-H460 | 0.0 | 0.4 | 0.8 | 0.0 |
| Lung Ca. (non-sm. cell) A549 | 0.0 | 0.8 | 4.0 | 0.0 |
| Lung ca. (non-s. cell) NCI-H23 | 0.7 | 2.4 | 5.3 | 0.3 |
| Lung ca. (non-s. cell) HOP-62 | 0.2 | 1.3 | 5.4 | 0.0 |
| Lung ca. (non-s. cl) NCI-H522 | 16.0 | 15.3 | 13.3 | 0.4 |
| Lung ca. (squam.) SW 900 | 4.7 | 17.1 | 16.5 | 3.7 |
| Lung ca. (squam.) NCI-H596 | 0.0 | 0.0 | 0.3 | 0.0 |
| Mammary gland | 66.0 | 55.1 | 37.6 | 53.6 |
| Breast ca.* (pl. ef) MCF-7 | 0.2 | 4.2 | 9.4 | 0.9 |
| Breast ca.* (pl. ef) MDA-MB-231 | 0.0 | 0.8 | 2.7 | 0.1 |
| Breast ca.* (pl. ef) T47D | 4.0 | 8.7 | 11.2 | 1.9 |
| Breast ca. BT-549 | 100.0 | 97.9 | 100.0 | 100.0 |
| Breast ca. MDA-N | 0.0 | 0.0 | 0.1 | 0.0 |
| Ovary | 4.8 | 15.0 | 14.5 | 5.7 |
| Ovarian Ca. OVCAR-3 | 0.4 | 1.2 | 5.8 | 0.3 |
| Ovarian Ca. OVCAR-4 | 0.0 | 1.0 | 3.1 | 0.0 |
| Ovarian ca. OVCAR-5 | 11.7 | 36.1 | 24.0 | 4.8 |
| Ovarian ca. OVCAR-8 | 4.1 | 13.6 | 11.7 | 1.3 |
| Ovarian ca. IGROV-1 | 3.8 | 13.7 | 10.0 | 1.6 |
| Ovarian Ca. (ascites) SK-OV-3 | 1.1 | 3.9 | 5.2 | 0.2 |
| Uterus | 2.1 | 19.1 | 7.4 | 0.5 |
| Placenta | 0.3 | 5.0 | 9.2 | 0.5 |
| Prostate | 40.9 | 47.0 | 34.4 | 11.3 |
| Prostate ca.* (bone met) PC-3 | 1.0 | 7.9 | 9.3 | 0.2 |
| Testis | 1.7 | 17.2 | 20.9 | 3.5 |
| Melanoma Hs688(A).T | 34.9 | 44.4 | 33.0 | 19.9 |
| Melanoma* (met) Hs688(B).T | 17.7 | 38.7 | 23.0 | 10.8 |
| Melanoma UACC-62 | 0.0 | 0.0 | 0.4 | 0.0 |
| Melanoma M14 | 0.1 | 1.1 | 5.0 | 0.1 |
| Melanoma LOX IMVI | 0.0 | 0.0 | 0.0 | 0.0 |
| Melanoma* (met) SK-MEL-5 | 0.0 | 0.1 | 1.3 | 0.0 |
| Melanoma SK-MEL-28 | 0.1 | 11.9 | 6.7 | 0.1 |

TABLE LG

Panel 1.3D

| Tissue Name | Rel. Exp. (%) Ag252, Run 165628866 |
|---|---|
| Liver adenocarcinoma | 13.9 |
| Pancreas | 4.7 |
| Pancreatic ca. CAPAN 2 | 4.1 |
| Adrenal gland | 6.7 |
| Thyroid | 5.1 |

TABLE LG-continued

Panel 1.3D

| Tissue Name | Rel. Exp. (%) Ag252, Run 165628866 |
|---|---|
| Salivary gland | 13.6 |
| Pituitary gland | 5.5 |
| Brain (fetal) | 28.5 |
| Brain (whole) | 43.8 |
| Brain (amygdala) | 32.3 |
| Brain (cerebellum) | 42.9 |
| Brain (hippocampus) | 44.1 |
| Brain (substantia nigra) | 4.1 |
| Brain (thalamus) | 14.8 |
| Cerebral Cortex | 25.5 |
| Spinal cord | 2.6 |
| glio/astro U87-MG | 2.0 |
| glio/astro U-118-MG | 10.2 |
| astrocytoma SW1783 | 10.6 |
| neuro*; met SK-N-AS | 1.7 |
| astrocytoma SF-539 | 4.9 |
| astrocytoma SNB-75 | 10.1 |
| glioma SNB-19 | 6.6 |
| glioma U251 | 8.4 |
| glioma SF-295 | 1.4 |
| Heart (fetal) | 11.8 |
| Heart | 7.6 |
| Skeletal muscle (fetal) | 7.4 |
| Skeletal muscle | 0.0 |
| Bone marrow | 1.8 |
| Thymus | 12.1 |
| Spleen | 0.0 |
| Lymph node | 15.7 |
| Colorectal | 0.0 |
| Stomach | 4.9 |
| Small intestine | 13.7 |
| Colon ca. SW480 | 12.0 |
| Colon ca.* SW620 (SW480 met) | 2.9 |
| Colon ca. HT29 | 2.3 |
| Colon ca. HCT-116 | 2.9 |
| Colon ca. CaCo-2 | 2.9 |
| Colon ca. tissue (ODO3866) | 2.9 |
| Colon ca. HCC-2998 | 2.8 |
| Gastric ca.* (liver met) NCI-N87 | 12.9 |
| Bladder | 4.1 |
| Trachea | 34.2 |
| Kidney | 4.7 |
| Kidney (fetal) | 22.8 |
| Renal ca. 786-0 | 0.0 |
| Renal ca. A498 | 19.5 |
| Renal ca. RXF 393 | 53.2 |
| Renal ca. ACHN | 2.4 |
| Renal ca. UO-31 | 1.4 |
| Renal ca. TK-10 | 1.4 |
| Liver | 3.2 |
| Liver (fetal) | 1.4 |
| Liver ca. (hepatoblast) HepG2 | 100.0 |
| Lung | 6.3 |
| Lung (fetal) | 10.2 |
| Lung ca. (small cell) LX-1 | 2.8 |
| Lung ca. (small cell) NCI-H69 | 64.2 |
| Lung ca. (s. cell var.) SHP-77 | 5.9 |
| Lung ca. (large cell) NCI-H460 | 6.4 |
| Lung ca. (non-sm. cell) A549 | 3.3 |
| Lung ca. (non-s. cell) NCI-H23 | 21.6 |
| Lung ca. (non-s. cell) HOP-62 | 11.9 |
| Lung ca. (non-s. cl) NCI-H522 | 40.9 |
| Lung ca. (squam.) SW 900 | 1.7 |
| Lung ca. (squam.) NCI-H596 | 23.3 |
| Mammary gland | 6.9 |
| Breast ca.* (pl. ef) MCF-7 | 6.8 |
| Breast ca.* (pl. ef) MDA-MB-231 | 47.0 |
| Breast ca.* (pl. ef) T47D | 0.0 |
| Breast ca. BT-549 | 22.4 |
| Breast ca. MDA-N | 3.1 |
| Ovary | 0.6 |
| Ovarian ca. OVCAR-3 | 7.1 |
| Ovarian ca. OVCAR-4 | 9.5 |
| Ovarian ca. OVCAR-5 | 2.2 |
| Ovarian ca. OVCAR-8 | 20.6 |
| Ovarian ca. IGROV-1 | 0.0 |
| Ovarian ca.* (ascites) SK-OV-3 | 9.7 |
| Uterus | 6.1 |
| Placenta | 4.9 |
| Prostate | 21.2 |
| Prostate ca.* (bone met) PC-3 | 15.7 |
| Testis | 5.0 |
| Melanoma Hs688(A).T | 1.6 |
| Melanoma* (met) Hs688(B).T | 4.9 |
| Melanoma UACC-62 | 2.7 |
| Melanoma M14 | 3.2 |
| Melanoma LOX IMVI | 3.0 |
| Melanoma* (met) SK-MEL-5 | 1.3 |
| Adipose | 0.0 |

TABLE LH

Panel 2D

| Tissue Name | Rel. Exp. (%) Ag252, Run 144791435 |
|---|---|
| Normal Colon | 11.3 |
| CC Well to Mod Diff (ODO3866) | 11.0 |
| CC Margin (ODO3866) | 1.6 |
| CC Gr.2 rectosigmoid (ODO3868) | 9.7 |
| CC Margin (ODO3868) | 2.5 |
| CC Mod Diff (ODO3920) | 20.9 |
| CC Margin (ODO3920) | 3.0 |
| CC Gr.2 ascend colon (ODO3921) | 3.2 |
| CC Margin (ODO3921) | 1.8 |
| CC from Partial Hepatectomy (ODO4309) Mets | 18.7 |
| Liver Margin (ODO4309) | 2.3 |
| Colon mets to lung (OD04451-01) | 14.0 |
| Lung Margin (OD04451-02) | 17.1 |
| Normal Prostate 6546-1 | 20.6 |
| Prostate Cancer (OD04410) | 30.1 |
| Prostate Margin (OD04410) | 18.4 |

TABLE LH-continued

Panel 2D

| Tissue Name | Rel. Exp. (%) Ag252, Run 144791435 |
|---|---|
| Prostate Cancer (OD04720-01) | 36.9 |
| Prostate Margin (OD04720-02) | 24.0 |
| Normal Lung 061010 | 15.3 |
| Lung Met to Muscle (ODO4286) | 1.5 |
| Muscle Margin (ODO4286) | 11.1 |
| Lung Malignant Cancer (OD03126) | 23.5 |
| Lung Margin (OD03126) | 19.5 |
| Lung Cancer (OD04404) | 10.5 |
| Lung Margin (OD04404) | 53.2 |
| Lung Cancer (OD04565) | 12.9 |
| Lung Margin (OD04565) | 23.8 |
| Lung Cancer (OD04237-01) | 4.9 |
| Lung Margin (OD04237-02) | 32.5 |
| Ocular Mel Met to Liver (ODO4310) | 2.0 |
| Liver Margin (ODO4310) | 5.4 |
| Melanoma Mets to Lung (OD04321) | 0.7 |
| Lung Margin (OD04321) | 24.5 |
| Normal Kidney | 8.3 |
| Kidney Ca, Nuclear grade 2 (OD04338) | 22.5 |
| Kidney Margin (OD04338) | 4.1 |
| Kidney Ca Nuclear grade 1/2 (OD04339) | 10.9 |
| Kidney Margin (OD04339) | 6.5 |
| Kidney Ca, Clear cell type (OD04340) | 26.8 |
| Kidney Margin (OD04340) | 10.4 |
| Kidney Ca, Nuclear grade 3 (OD04348) | 3.7 |
| Kidney Margin (OD04348) | 6.0 |
| Kidney Cancer (OD04622-01) | 100.0 |
| Kidney Margin (OD04622-03) | 6.5 |
| Kidney Cancer (OD04450-01) | 4.5 |
| Kidney Margin (OD04450-03) | 7.4 |
| Kidney Cancer 8120607 | 3.5 |
| Kidney Margin 8120608 | 8.7 |
| Kidney Cancer 8120613 | 1.2 |
| Kidney Margin 8120614 | 6.1 |
| Kidney Cancer 9010320 | 12.5 |
| Kidney Margin 9010321 | 9.9 |
| Normal Uterus | 18.9 |
| Uterus Cancer 064011 | 15.6 |
| Normal Thyroid | 3.3 |
| Thyroid Cancer 064010 | 6.9 |
| Thyroid Cancer A302152 | 10.9 |
| Thyroid Margin A302153 | 5.7 |
| Normal Breast | 42.3 |
| Breast Cancer (OD04566) | 26.6 |
| Breast Cancer (OD04590-01) | 21.8 |
| Breast Cancer Mets (OD04590-03) | 36.3 |
| Breast Cancer Metastasis (OD04655-05) | 14.9 |
| Breast Cancer 064006 | 21.5 |
| Breast Cancer 1024 | 42.0 |
| Breast Cancer 9100266 | 11.0 |
| Breast Margin 9100265 | 10.8 |
| Breast Cancer A209073 | 14.9 |
| Breast Margin A2090734 | 13.0 |
| Normal Liver | 6.4 |
| Liver Cancer 064003 | 0.0 |
| Liver Cancer 1025 | 1.1 |
| Liver Cancer 1026 | 19.6 |
| Liver Cancer 6004-T | 10.0 |
| Liver Tissue 6004-N | 6.0 |
| Liver Cancer 6005-T | 15.3 |
| Liver Tissue 6005-N | 3.3 |
| Normal Bladder | 19.2 |
| Bladder Cancer 1023 | 5.6 |
| Bladder Cancer A302173 | 3.4 |
| Bladder Cancer (OD04718-01) | 7.6 |
| Bladder Normal Adjacent (OD04718-03) | 9.3 |
| Normal Ovary | 2.4 |
| Ovarian Cancer 064008 | 11.8 |
| Ovarian Cancer OD04768-07) | 2.9 |
| Ovary Margin (OD04768-08) | 31.4 |
| Normal Stomach | 5.6 |
| Gastric Cancer 9060358 | 0.0 |
| Stomach Margin 9060359 | 1.9 |
| Gastric Cancer 9060395 | 5.9 |
| Stomach Margin 9060394 | 2.4 |
| Gastric Cancer 9060397 | 18.6 |
| Stomach Margin 9060396 | 2.8 |
| Gastric Cancer 064005 | 1.5 |

TABLE LI.

Panel 4D

| Tissue Name | Rel. Exp.(%) Ag1513, Run 163478079 | Rel. Exp.(%) Ag1937, Run 161702009 | Rel. Exp.(%) Ag422, Run 138056654 | Tissue Name | Rel. Exp.(%) Ag1513, Run 163478079 | Rel. Exp.(%) Ag1937, Run 161702009 | Rel. Exp.(%) Ag422, Run 138056654 |
|---|---|---|---|---|---|---|---|
| Secondary Th1 act | 0.7 | 0.0 | 0.0 | HUVEC IL-1beta | 2.9 | 2.0 | 3.5 |
| Secondary Th2 act | 0.8 | 0.0 | 0.0 | HUVEC IFN gamma | 27.2 | 18.4 | 25.9 |
| Secondary Tr1 act | 0.5 | 0.0 | 4.0 | HUVEC TNF alpha + IFN gamma | 8.5 | 9.9 | 2.0 |
| Secondary Th1 rest | 1.7 | 0.0 | 5.6 | HUVEC TNF alpha + IL4 | 7.9 | 5.9 | 13.7 |
| Secondary Th2 rest | 14.0 | 10.0 | 15.2 | HUVEC IL-11 | 15.6 | 15.9 | 17.8 |
| Secondary Tr1 rest | 6.2 | 0.0 | 5.7 | Lung Microvascular EC none | 27.7 | 25.7 | 23.8 |
| Primary Th1 act | 1.9 | 2.1 | 1.1 | Lung Microvascular EC TNFalpha + IL-1 beta | 24.0 | 22.5 | 19.1 |
| Primary Th2 act | 2.1 | 2.3 | 9.9 | Microvascular Dermal EC none | 14.2 | 15.9 | 17.4 |
| Primary Tr1 act | 0.2 | 0.6 | 4.5 | Microsvascular Dermal EC TNFalpha + IL-1beta | 8.2 | 9.4 | 25.3 |
| Primary Th1 rest | 16.3 | 10.0 | 15.7 | Bronchial epithelium TNFalpha + IL1beta | 4.0 | 2.2 | 1.3 |
| Primary Th2 rest | 7.4 | 9.1 | 21.9 | Small airway epithelium none | 1.9 | 1.6 | 1.5 |
| Primary Tr1 rest | 11.6 | 11.0 | 13.9 | Small airway epithelium TNFalpha + IL-1beta | 0.5 | 6.4 | 2.6 |
| CD45RA CD4 lymphocyte act | 13.7 | 9.4 | 16.6 | Coronery artery SMC rest | 23.2 | 29.7 | 33.9 |
| CD45RO CD4 lymphocyte act | 1.1 | 0.6 | 3.1 | Coronery artery SMC TNFalpha + IL-1beta | 33.4 | 19.5 | 13.5 |
| CD8 lymphocyte act | 1.5 | 0.9 | 1.1 | Astrocytes rest | 0.0 | 26.6 | 17.2 |
| Secondary CD8 lymphocyte rest | 4.0 | 3.3 | 5.0 | Astrocytes TNFalpha + IL-1beta | 100.0 | 100.0 | 100.0 |
| Secondary CD8 lymphocyte act | 0.0 | 0.0 | 0.0 | KU-812 (Basophil) rest | 0.6 | 0.0 | 0.0 |
| CD4 lymphocyte none | 19.8 | 18.6 | 30.8 | KU-812 (Basophil) PMA/ionomycin | 0.0 | 0.5 | 0.0 |
| 2ry Th1/Th2/Tr1_anti-CD95 CH11 | 6.2 | 4.1 | 19.9 | CCD1106 (Keratinocytes) none | 1.9 | 0.6 | 3.5 |
| LAK cells rest | 8.4 | 8.7 | 17.4 | CCD1106 (Keratinocytes) TNFalpha + IL-1beta | 0.5 | 2.1 | 3.8 |
| LAK cells IL-2 | 1.6 | 6.2 | 5.8 | Liver cirrhosis | 9.1 | 12.2 | 13.0 |
| LAK cells IL-2 + IL-12 | 4.3 | 4.0 | 8.4 | Lupus kidney | 3.0 | 2.6 | 3.8 |
| LAK cells IL-2 + IFN gamma | 1.0 | 8.1 | 4.1 | NCI-H292 none | 30.1 | 41.8 | 25.7 |
| LAK cells IL-2 + IL-18 | 1.3 | 8.3 | 1.3 | NCI-H292 IL-4 | 16.8 | 35.1 | 16.5 |
| LAK cells PMA/ionomycin | 2.6 | 1.2 | 2.5 | NCI-H292 IL-9 | 21.9 | 28.5 | 32.8 |
| NK Cells IL-2 rest | 1.2 | 4.8 | 6.8 | NCI-H292 IL-13 | 37.6 | 28.1 | 33.7 |
| Two Way MLR 3 day | 8.1 | 13.5 | 3.7 | NCI-H292 IFN gamma | 20.3 | 23.5 | 22.5 |
| Two Way MLR 5 day | 1.3 | 5.0 | 1.4 | HPAEC none | 36.1 | 23.5 | 31.6 |

TABLE LI.-continued

Panel 4D

| Tissue Name | Rel. Exp.(%) Ag1513, Run 163478079 | Rel. Exp.(%) Ag1937, Run 161702009 | Rel. Exp.(%) Ag422, Run 138056654 | Tissue Name | Rel. Exp.(%) Ag1513, Run 163478079 | Rel. Exp.(%) Ag1937, Run 161702009 | Rel. Exp.(%) Ag422, Run 138056654 |
|---|---|---|---|---|---|---|---|
| Two Way MLR 7 day | 1.0 | 2.0 | 2.6 | HPAEC TNF alpha + IL-1 beta | 22.7 | 11.1 | 24.5 |
| PBMC rest | 3.0 | 3.7 | 7.8 | Lung fibroblast none | 10.7 | 15.0 | 14.4 |
| PBMC PWM | 5.2 | 2.3 | 3.6 | Lung fibroblast TNF alpha + IL-1 beta | 1.9 | 2.6 | 1.2 |
| PBMC PHA-L | 1.0 | 1.9 | 2.6 | Lung fibroblast IL-4 | 11.0 | 9.7 | 7.7 |
| Ramos (B cell) none | 0.0 | 0.0 | 0.0 | Lung fibroblast IL-9 | 11.3 | 9.3 | 13.2 |
| Ramos (B cell) ionomycin | 0.0 | 0.0 | 0.0 | Lung fibroblast IL-13 | 7.3 | 4.5 | 17.4 |
| B lymphocytes PWM | 1.1 | 1.4 | 1.4 | Lung fibroblast IFN gamma | 7.1 | 10.6 | 9.4 |
| B lymphocytes CD40L and IL-4 | 2.1 | 3.7 | 8.1 | Dermal fibroblast CCD1070 rest | 33.2 | 51.4 | 45.4 |
| EOL-1 dbcAMP | 4.7 | 3.4 | 4.3 | Dermal fibroblast CCD1070 TNF alpha | 24.0 | 31.9 | 21.3 |
| EOL-1 dbcAMP PMA/ionomycin | 3.6 | 1.3 | 10.7 | Dermal fibroblast CCD1070 IL-1 beta | 34.6 | 34.4 | 46.3 |
| Dendritic cells none | 1.7 | 1.9 | 3.3 | Dermal fibroblast IFN gamma | 30.6 | 27.0 | 32.3 |
| Dendritic cells LPS | 0.0 | 0.0 | 1.2 | Dermal fibroblast IL-4 | 34.4 | 29.7 | 33.9 |
| Dendritic cells anti-CD40 | 1.6 | 0.6 | 1.8 | IBD Colitis 2 | 1.7 | 1.4 | 3.0 |
| Monocytes rest | 5.0 | 4.8 | 6.3 | IBD Crohn's | 0.7 | 0.0 | 1.3 |
| Monocytes LPS | 0.4 | 0.6 | 1.4 | Colon | 12.9 | 9.2 | 25.0 |
| Macrophages rest | 12.3 | 9.0 | 13.8 | Lung | 25.7 | 55.5 | 42.9 |
| Macrophages LPS | 0.5 | 0.6 | 0.0 | Thymus | 12.2 | 18.0 | 18.3 |
| HUVEC none | 4.2 | 22.5 | 15.6 | Kidney | 26.8 | 39.2 | 25.3 |
| HUVEC starved | 17.3 | 22.7 | 17.1 | | | | |

TABLE LJ

Panel 4R

| Tissue Name | Rel. Exp. (%) Ag422, Run 138232477 |
|---|---|
| Secondary Th1 act | 0.8 |
| Secondary Th2 act | 1.4 |
| Secondary Tr1 act | 0.2 |
| Secondary Th1 rest | 2.1 |
| Secondary Th2 rest | 6.1 |
| Secondary Tr1 rest | 4.1 |
| Primary Th1 act | 2.2 |
| Primary Th2 act | 3.6 |
| Primary Tr1 act | 1.3 |
| Primary Th1 rest | 8.1 |
| Primary Th2 rest | 5.1 |
| Primary Tr1 rest | 1.1 |
| CD45RA CD4 lymphocyte act | 7.5 |
| CD45RO CD4 lymphocyte act | 4.6 |
| CD8 lymphocyte act | 1.4 |
| Secondary CD8 lymphocyte rest | 5.9 |
| Secondary CD8 lymphocyte act | 0.0 |
| CD4 lymphocyte none | 27.0 |
| 2ry Th1/Th2/Tr1_anti-CD95 CH11 | 17.0 |
| LAK cells rest | 10.9 |
| LAK cells IL-2 | 6.9 |
| LAK cells IL-2 + IL-12 | 11.8 |
| LAK cells IL-2 + IFN gamma | 16.8 |
| LAK cells IL-2 + IL-18 | 6.2 |
| LAK cells PMA/ionomycin | 3.7 |
| NK Cells IL-2 rest | 4.6 |
| Two Way MLR 3 day | 9.5 |
| Two Way MLR 5 day | 3.4 |

TABLE LJ-continued

Panel 4R

| Tissue Name | Rel. Exp. (%) Ag422, Run 138232477 |
|---|---|
| Two Way MLR 7 day | 1.7 |
| PBMC rest | 5.7 |
| PBMC PWM | 9.2 |
| PBMC PHA-L | 4.5 |
| Ramos (B cell) none | 0.0 |
| Ramos (B cell) ionomycin | 0.0 |
| B lymphocytes PWM | 3.5 |
| B lymphocytes CD40L and IL-4 | 12.8 |
| EOL-1 dbcAMP | 5.3 |
| EOL-1 dbcAMP PMA/ionomycin | 5.0 |
| Dendritic cells none | 3.3 |
| Dendritic cells LPS | 1.3 |
| Dendritic cells anti-CD40 | 1.8 |
| Monocytes rest | 6.7 |
| Monocytes LPS | 2.9 |
| Macrophages rest | 12.1 |
| Macrophages LPS | 0.6 |
| HUVEC none | 15.7 |
| HUVEC starved | 73.7 |
| HUVEC IL-1 beta | 37.4 |
| HUVEC IFN gamma | 9.5 |
| HUVEC TNF alpha + IFN gamma | 4.2 |
| HUVEC TNF alpha + IL4 | 6.4 |
| HUVEC IL-11 | 17.1 |
| Lung Microvascular EC none | 17.8 |
| Lung Microvascular EC TNF alpha + IL-1 beta | 28.5 |
| Microvascular Dermal EC none | 17.8 |
| Microsvasular Derman EC TNF alpha + IL-1 beta | 9.9 |
| Bronchial epithelium TNF alpha + IL-1 beta | 2.1 |
| Small airway epithelium none | 3.3 |
| Small airway epithelium TNF alpha + IL-1 beta | 8.5 |
| Coronery artery SMC rest | 40.6 |
| Coronery artery SMC TNF alpha + IL-1 beta | 17.2 |
| Astrocytes rest | 19.2 |
| Astrocytes TNF alpha + IL-1 beta | 56.3 |
| KU-812 (Basophil) rest | 0.3 |
| KU-812 (Basophil) PMA/ionomycin | 1.6 |
| CCD1106 (Keratinocytes) none | 1.6 |
| CCD1106 (Keratinocytes) TNF alpha + IL-1 beta | 13.8 |
| Liver cirrhosis | 26.6 |
| Lupus kidney | 7.2 |
| NCI-H292 none | 47.6 |
| NCI-H292 IL-4 | 94.6 |
| NCI-H292 IL-9 | 62.4 |
| NCI-H292 IL-13 | 11.9 |
| NCI-H292 IFN gamma | 8.1 |
| HPAEC none | 27.7 |
| HPAEC TNF alpha + IL-1 beta | 21.6 |
| Lung fibroblast none | 12.6 |
| Lung fibroblast TNF alpha + IL-1 beta | 2.8 |
| Lung fibroblast IL-4 | 12.3 |
| Lung fibroblast IL-9 | 10.2 |
| Lung fibroblast IL-13 | 2.6 |
| Lung fibroblast IFN gamma | 13.5 |
| Dermal fibroblast CCD1070 rest | 63.3 |
| Dermal fibroblast CCD1070 TNF alpha | 100.0 |
| Dermal fibroblast CCD1070 IL-1 beta | 20.0 |
| Dermal fibroblast IFN gamma | 25.9 |
| Dermal fibroblast IL-4 | 18.6 |
| IBD Colitis 1 | 3.6 |
| IBD Colitis 2 | 1.5 |
| IBD Crohn's | 2.0 |
| Colon | 8.5 |
| Lung | 64.2 |
| Thymus | 12.9 |
| Kidney | 48.3 |

Panel 1 Summary: Ag252/252b/Ag422 Multiple experiments with three different probe and primer sets produce results that are in excellent agreement, with highest expression of the CG56449-02 gene in a breast cancer cell line BT-549 (CTs=24) and the fetal lung. Based on homology, the protein encoded by this gene contains numerous EGF-motifs and may be required for cell growth and proliferation. The expression profile suggests that this gene product may be involved in brain, colon, renal, lung, ovarian and prostate cancer as well as melanomas. Thus, expression of this gene could be used as a diagnostic marker for the presence of these cancers. Furthermore, therapeutic inhibition of the expression or function of this gene product through the use of antibodies or small molecule drugs might be of use in the treatment of these cancers.

Among tissues with metabolic function, this gene is expressed at moderate to low levels in pancreas, adrenal, thyroid, pituitary, heart, skeletal muscle, and adult and fetal liver. This widespread expression suggests that this gene product may be important for the pathogenesis, diagnosis, and/or treatment of metabolic and endocrine diseases, including obesity and Types 1 and 2 diabetes.

In addition, this gene shows consistent low/moderate levels of expression in the brain. Please see Panel 1.3D for discussion of utility of this gene in the central nervous system.

Panel 1.3D Summary: Ag252 Highest levels of expression of the CG56449-02 gene are seen in a liver cell line HepG2 (CT=30.27). Based on expression in this panel, this gene may be involved in brain, colon, renal, lung, ovarian and prostate cancer as well as melanomas. Thus, expression of this gene could be used as a diagnostic marker for the presence of these cancers. Furthermore, therapeutic inhibition using antibodies or small molecule drugs might be of use in the treatment of these cancers.

This gene product also shows low but significant levels of expression in pancreas, adrenal, thyroid, pituitary, adult and fetal heart, and adult and fetal liver. This widespread expression in tissues with metabolic function is in agreement with results from Panel 1 and suggests that this gene product may be important for the pathogenesis, diagnosis, and/or treatment of metabolic and endocrine diseases, including obesity and Types 1 and 2 diabetes. Furthermore, this gene is more highly expressed in fetal (CT=34) skeletal muscle when compared to expression in the adult (CT=40) and may be useful for the differentiation of the fetal and adult sources of this tissue.

In addition, this gene is expressed at moderate levels in the CNS, again consistent with Panel 1. This gene encodes a mouse epidermal growth factor homolog, and thus may increase axonal or dendritic outgrowth and synaptogenesis. Therefore, this gene may be of use in the treatment of clinical conditions associated with neuron loss such as head or spinal cord trauma, stroke, or any neurodegenerative disease.

Panel 2D Summary: Ag252 The CG56449-02 gene is expressed at low levels in all the samples on this panel, with highest expression in a kidney cancer sample (CT=31.1). Gastric, liver and colon cancers express this gene at a higher level than the normal adjacent tissue from these organs. There also appears to be increased expression in normal lung and ovarian tissue when compared to the adjacent tumor samples. These data indicate that the expression of this gene might be associated with gastric, liver and colon cancer and thus, therapeutic modulation of this gene product might be of use in the treatment of these cancers. Conversely, absence of expression is associated with ovarian and lung cancer and could potentially be used as a diagnostic marker for the presence of these cancers. Furthermore, therapeutic modulation of this gene might be of use in the treatment of these cancers.

Panel 3D Summary: Ag252 Data from one experiment with this probe and primer and the CG56449-02 gene is not included because the amp plot suggests that there were experimental difficulties with this run.

Panels 4D/4R Summary: Ag1513/Ag1937/Ag422 Multiple experiments with different probe and primer sets produce results that are in excellent agreement. The CG56449-02 transcript is expressed at low levels in T cells, fibroblasts, endothelium, smooth muscle cells and T cells regardless of treatment. The transcript is also expressed in normal colon, lung and thymus. However, TNF alpha and IL-1beta induce the expression of the transcript in astrocytes. Thus, the transcript encodes a Notch like protein which may function in astrocyte differentiation and activation. Therefore, therapeutic regulation of this transcript or the design of therapeutics with the encoded protein could be important in the treatment of multiple scelrosis or other inflammatory diseases of the CNS.

REFERENCES

Tanigaki K, Nogaki F, Takahashi J, Tashiro K, Kurooka H, Honjo T. Notch1 and Notch3 instructively restrict bFGF-responsive multipotent neural progenitor cells to an astroglial fate. Neuron 2001 January; 29(1):45–55

Notch1 has been shown to induce glia in the peripheral nervous system. However, it has not been known whether Notch can direct commitment to glia from multipotent progenitors of the central nervous system. Here we present evidence that activated Notch1 and Notch3 promotes the differentiation of astroglia from the rat adult hippocampus-derived multipotent progenitors (AHPs). Quantitative clonal analysis indicates that the action of Notch is likely to be instructive. Transient activation of Notch can direct commitment of AHPs irreversibly to astroglia. Astroglial induction by Notch signaling was shown to be independent of STAT3, which is a key regulatory transcriptional factor when ciliary neurotrophic factor (CNTF) induces astroglia. These data suggest that Notch provides a CNTF-independent instructive signal of astroglia differentiation in CNS multipotent progenitor cells.

PMID: 11182080

Irvin D K, Zurcher S D, Nguyen T, Weinmaster G, Kornblum H I. Expression patterns of Notch1, Notch2, and Notch3 suggest multiple functional roles for the Notch-DSL signaling system during brain development. J Comp Neurol 2001 Jul. 23; 436(2):167–81

The Notch-DSL signaling system consists of multiple receptors and ligands, and plays many roles in development. The function of Notch receptors and ligands in mammalian brain, however, is poorly understood. In the current study, we examined the expression patterns for three receptors of this system, Notch 1, 2, and 3, in late embryonic and postnatal rat brain by in situ hybridization. The three receptors have overlapping but different patterns of expression. Messenger RNA for all three proteins is found in postnatal central nervous system (CNS) germinal zones and, in early postnatal life, within numerous cells throughout the CNS. Within zones of cellular proliferation of the postnatal brain, Notch1 mRNA is found in both the subventricular and the ventricular germinal zones, whereas Notch2 and Notch3 mRNAs are more highly localized to the ventricular zones. Both Notch1 and Notch3 mRNAs are expressed along the inner aspect of the dentate gyrus, a site of adult neurogenesis. Notch2 mRNA is expressed in the external granule cell layer of the developing cerebellum. In several brain areas, Notch1 and Notch2 mRNAs are relatively concentrated in white matter, whereas Notch3 mRNA is not. Neurosphere cultures (which contain CNS stem cells), purified astrocyte cultures, and striatal neuron-enriched cultures express Notch1 mRNA. However, in these latter cultures, Notch1 mRNA is produced by nestin-containing cells, rather than by postmitotic neurons. Taken together, these results support multiple roles for Notch1, 2, and 3 receptor activation during CNS development, particularly during gliogenesis. Copyright 2001 Wiley-Liss, Inc.

PMID: 11438922

Colombatti M, Moretto G, Tommasi M, Fiorini E, Poffe O, Colombara M, Tanel R, Tridente G, Ramarli D. Human MBP-specific T cells regulate IL-6 gene expression in astrocytes through cell—cell contacts and soluble factors. Glia 2001 September; 35(3):224–33

One of the distinctive features of multiple sclerosis (MS) attacks is homing to the CNS of activated T cells able to orchestrate humoral and cell-based events, resulting in immune-mediated injury to myelin and oligodendrocytes. Of the complex interplay occurring between T cells and CNS constituents, we have examined some aspects of T-cell interactions with astrocytes, the major components of the glial cells. Specifically, we focused on the ability of T cells to regulate the gene expression of interleukin-6 (IL-6) in astrocytes, based on previous evidence showing the involvement of this cytokine in CNS disorders. We found that T-cell adhesion and T-cell soluble factors induce IL-6 gene expression in U251 astrocytes through distinct signaling pathways, respectively, resulting in the activation of NF-kappaB and IRF-1 transcription factors. In a search for effector molecules at the astrocyte surface, we found that alpha3beta1 integrins play a role in NF-kappaB activation induced by T-cell contact, whereas interferon-gamma (IFN-gamma) receptors dominate in IRF-1 induction brought about by T-cell-derived soluble factors. Similar phenomena were observed also in normal fetal astrocyte cultures. We therefore propose that through astrocyte induction, T cells may indirectly regulate the availability of a cytokine which is crucial in modulating fate and behavior of cell populations involved in the pathogenesis of MS inflammatory lesions.

PMID: 11494413

NOV16: AL359846_A_da1: GPCR

Expression of gene AL359846_A_da1 was assessed using the primer-probe sets Ag1851, Ag2544 and Ag1706, described in Tables MA, MB and MC. Results of the RTQ-PCR runs are shown in Tables MD, ME, MF, MG and MH.

TABLE MA

Probe Name Ag1851

| Primers | Sequences | Length | Start Position |
|---|---|---|---|
| Forward | 5'-ttaattgtgctgagggaagaaa-3' (SEQ ID NO:407) | 22 | 685 |
| Probe | TET-5'-cttctctacctgttcagcgcactcga-3'-TAMRA (SEQ ID NO:408) | 26 | 713 |
| Reverse | 5'-aagggctgaaccgtagaataag-3' (SEQ ID NO:409) | 22 | 749 |

TABLE MB

Probe Name Ag2544

| Primers | Sequences | Length | Start Position |
|---|---|---|---|
| Forward | 5'-ttattctacggttcagcccttt-3' (SEQ ID NO: 410) | 22 | 750 |
| Probe | TET-5'-tgtacatgaaacccaagtcaaagaaca-3'-TAMRA (SEQ ID NO: 411) | 27 | 775 |
| Reverse | 5'-cactccataagacagcccaata-3' (SEQ ID NO: 412) | 22 | 821 |

TABLE MC

Probe Name Ag1706

| Primers | Sequences | Length | Start Position |
|---|---|---|---|
| Forward | 5'-ttaattgtgctgagggaagaaa-3' (SEQ ID NO: 413) | 22 | 685 |
| Probe | TET-5'-cttctctacctgttcagcgcactcga-3'-TAMRA (SEQ ID NO: 414) | 26 | 713 |
| Reverse | 5'-aagggctgaaccgtagaataag-3' (SEQ ID NO: 415) | 22 | 749 |

TABLE MD

CNS_neurodegeneration_v1.0

| Tissue Name | Rel. Exp. (%) Ag1851, Run 207926307 | Rel. Exp. (%) Ag2544, Run 206974241 | Tissue Name | Rel. Exp. (%) Ag1851, Run 207926307 | Rel. Exp. (%) Ag2544, Run 206974241 |
|---|---|---|---|---|---|
| AD 1 Hippo | 14.1 | 16.3 | Control (Path) 3 Temporal Ctx | 2.1 | 14.0 |
| AD 2 Hippo | 57.4 | 35.6 | Control (Path) 4 Temporal Ctx | 55.9 | 34.2 |
| AD 3 Hippo | 12.3 | 9.9 | AD 1 Occipital Ctx | 24.3 | 13.0 |
| AD 4 Hippo | 8.6 | 18.9 | AD 2 Occipital Ctx (Missing) | 0.0 | 0.0 |
| AD 5 hippo | 56.6 | 28.1 | AD 3 Occipital Ctx | 7.6 | 10.0 |
| AD 6 Hippo | 54.3 | 87.7 | AD 4 Occipital Ctx | 45.1 | 33.2 |
| Control 2 Hippo | 16.8 | 33.4 | AD 5 Occipital Ctx | 8.5 | 8.1 |
| Control 4 Hippo | 21.2 | 20.4 | AD 6 Occipital Ctx | 34.2 | 9.7 |
| Control (Path) 3 Hippo | 11.1 | 7.0 | Control 1 Occipital Ctx | 8.4 | 0.0 |
| AD 1 Temporal Ctx | 36.3 | 31.9 | Control 2 Occipital Ctx | 26.1 | 24.7 |
| AD 2 Temporal Ctx | 57.4 | 38.4 | Control 3 Occipital Ctx | 21.2 | 35.4 |

TABLE MD-continued

CNS_neurodegeneration_v1.0

| Tissue Name | Rel. Exp. (%) Ag1851, Run 207926307 | Rel. Exp. (%) Ag2544, Run 206974241 | Tissue Name | Rel. Exp. (%) Ag1851, Run 207926307 | Rel. Exp. (%) Ag2544, Run 206974241 |
|---|---|---|---|---|---|
| AD 3 Temporal Ctx | 10.8 | 9.2 | Control 4 Occipital Ctx | 2.7 | 12.9 |
| AD 4 Temporal Ctx | 24.8 | 26.8 | Control (Path) 1 Occipital Ctx | 73.7 | 77.4 |
| AD 5 Inf Temporal Ctx | 100.0 | 76.3 | Control (Path) 2 Occipital Ctx | 26.1 | 17.8 |
| AD 5 SupTemporal Ctx | 62.0 | 54.3 | Control (Path) 3 Occipital Ctx | 5.4 | 3.2 |
| AD 6 Inf Temporal Ctx | 33.9 | 57.0 | Control (Path) 4 Occipital Ctx | 35.1 | 7.6 |
| AD 6 Sup Temporal Ctx | 47.3 | 69.7 | Control 1 Parietal Ctx | 8.7 | 9.9 |
| Control 1 Temporal Ctx | 15.8 | 8.5 | Control 2 Parietal Ctx | 42.9 | 66.0 |
| Control 2 Temporal Ctx | 12.7 | 25.2 | Control 3 Parietal Ctx | 49.0 | 16.3 |
| Control 3 Temporal Ctx | 49.7 | 36.9 | Control (Path) 1 Parietal Ctx | 51.8 | 59.9 |
| Control 4 Temporal Ctx | 17.3 | 16.2 | Control (Path) 2 Parietal Ctx | 55.5 | 37.1 |
| Control (Path) 1 Temporal Ctx | 87.1 | 74.2 | Control (Path) 3 Parietal Ctx | 2.6 | 8.8 |
| Control (Path) 2 Temporal Ctx | 83.5 | 100.0 | Control (Path) 4 Parietal Ctx | 69.3 | 56.6 |

TABLE ME.

Panel 1.3D

| Tissue Name | Rel. Exp.(%) Ag1706, Run 165532719 | Rel. Exp.(%) Ag1851, Run 165974829 | Rel. Exp.(%) Ag2544, Run 165639972 | Tissue Name | Rel. Exp.(%) Ag1706, Run 165532719 | Rel. Exp.(%) Ag1851, Run 165974829 | Rel. Exp.(%) Ag2544, Run 165639972 |
|---|---|---|---|---|---|---|---|
| Liver adenocarcinoma | 0.0 | 0.0 | 0.0 | Kidney (fetal) | 14.3 | 0.0 | 11.1 |
| Pancreas | 0.0 | 0.0 | 21.2 | Renal ca. 786-0 | 14.1 | 11.2 | 7.7 |
| Pancreatic ca. CAPAN 2 | 0.0 | 6.8 | 8.4 | Renal ca. A498 | 33.9 | 17.0 | 26.8 |
| Adrenal gland | 0.0 | 0.0 | 4.9 | Renal ca. RXF 393 | 0.0 | 0.0 | 0.0 |
| Thyroid | 12.5 | 7.2 | 17.3 | Renal ca. ACHN | 7.0 | 8.8 | 0.0 |
| Salivary gland | 25.2 | 0.0 | 0.0 | Renal ca. UO-31 | 0.0 | 15.0 | 13.3 |
| Pituitary gland | 46.0 | 63.7 | 13.1 | Renal ca. TK-10 | 0.0 | 0.0 | 8.4 |
| Brain (fetal) | 25.5 | 22.2 | 37.1 | Liver | 15.5 | 8.3 | 100.0 |
| Brain (whole) | 100.0 | 43.2 | 46.3 | Liver (fetal) | 6.7 | 0.0 | 5.2 |
| Brain (amygdala) | 40.1 | 34.4 | 71.2 | Liver ca. (hepatoblast) HepG2 | 0.0 | 7.5 | 11.7 |
| Brain (cerebellum) | 0.0 | 31.9 | 24.8 | Lung | 0.0 | 0.0 | 0.0 |

TABLE ME.-continued

Panel 1.3D

| Tissue Name | Rel. Exp.(%) Ag1706, Run 165532719 | Rel. Exp.(%) Ag1851, Run 165974829 | Rel. Exp.(%) Ag2544, Run 165639972 | Tissue Name | Rel. Exp.(%) Ag1706, Run 165532719 | Rel. Exp.(%) Ag1851, Run 165974829 | Rel. Exp.(%) Ag2544, Run 165639972 |
|---|---|---|---|---|---|---|---|
| Brain (hippocampus) | 28.5 | 100.0 | 55.1 | Lung (fetal) | 6.7 | 33.7 | 8.2 |
| Brain (substantia nigra) | 21.8 | 0.0 | 5.0 | Lung ca. (small cell) LX-1 | 0.0 | 0.0 | 0.0 |
| Brain (thalamus) | 20.9 | 5.6 | 34.4 | Lung ca. (small cell) NCI-H69 | 0.0 | 0.0 | 0.0 |
| Cerebral Cortex | 6.5 | 13.8 | 12.2 | Lung ca. (s.cell var.) SHP-77 | 13.2 | 7.9 | 0.0 |
| Spinal cord | 21.5 | 30.1 | 10.7 | Lung ca. (large cell) NCI-H460 | 0.0 | 0.0 | 0.0 |
| glio/astro U87-MG | 18.0 | 7.7 | 0.0 | Lung ca. (non-sm. cell) A549 | 0.0 | 0.0 | 0.0 |
| glio/astro U-118-MG | 6.9 | 0.0 | 11.6 | Lung ca. (non-s.cell) NCI-H23 | 9.5 | 0.0 | 11.0 |
| astrocytoma SW1783 | 20.6 | 7.2 | 13.1 | Lung ca. (non-s.cell) HOP-62 | 7.4 | 0.0 | 0.0 |
| neuro*; met SK-N-AS | 0.0 | 0.0 | 0.0 | Lung ca. (non-s.cl) NCI-H522 | 9.9 | 0.0 | 0.0 |
| astrocytoma SF-539 | 17.1 | 8.8 | 19.8 | Lung ca. (squam.) SW 900 | 0.0 | 6.1 | 7.6 |
| astrocytoma SNB-75 | 0.0 | 0.0 | 17.2 | Lung ca. (squam.) NCI-H596 | 8.0 | 0.0 | 0.0 |
| glioma SNB-19 | 9.3 | 0.0 | 9.3 | Mammary gland | 0.0 | 0.0 | 11.0 |
| glioma U251 | 12.8 | 4.5 | 0.0 | Breast ca.* (pl.ef) MCF-7 | 0.0 | 0.0 | 0.0 |
| glioma SF-295 | 5.2 | 0.0 | 0.0 | Breast ca.* (pl.ef) MDA-MB-231 | 0.0 | 8.1 | 9.4 |
| Heart (fetal) | 0.0 | 0.0 | 0.0 | Breast ca.* (pl.ef) T47D | 6.3 | 0.0 | 0.0 |
| Heart | 0.0 | 15.7 | 36.6 | Breast ca. BT-549 | 17.8 | 0.0 | 40.3 |
| Skeletal muscle (fetal) | 0.0 | 0.0 | 0.0 | Breast ca. MDA-N | 0.0 | 0.0 | 0.0 |
| Skeletal muscle | 6.3 | 15.4 | 14.4 | Ovary | 0.0 | 0.0 | 10.2 |
| Bone marrow | 37.6 | 0.0 | 45.1 | Ovarian ca. OVCAR-3 | 25.9 | 31.6 | 46.0 |
| Thymus | 0.0 | 28.7 | 33.4 | Ovarian ca. OVCAR-4 | 11.3 | 19.1 | 6.1 |
| Spleen | 1.7 | 0.0 | 24.8 | Ovarian ca. OVCAR-5 | 6.3 | 11.3 | 36.3 |
| Lymph node | 21.2 | 33.0 | 35.8 | Ovarian ca. OVCAR-8 | 0.0 | 0.0 | 0.0 |
| Colorectal | 11.1 | 0.0 | 0.0 | Ovarian ca. IGROV-1 | 0.0 | 0.0 | 0.0 |
| Stomach | 9.4 | 8.9 | 28.5 | Ovarian ca.* (ascites) SK-OV-3 | 0.0 | 10.7 | 0.0 |
| Small intestine | 0.0 | 0.0 | 0.0 | Uterus | 0.0 | 15.0 | 7.4 |
| Colon ca. SW480 | 7.1 | 0.0 | 0.0 | Placenta | 0.0 | 9.9 | 0.0 |
| Colon ca.* SW620(SW480 met) | 13.1 | 0.0 | 0.0 | Prostate | 6.3 | 0.0 | 0.0 |
| Colon ca. HT29 | 0.0 | 0.0 | 0.0 | Prostate ca.* (bone met)PC-3 | 9.4 | 15.4 | 4.1 |

TABLE ME.-continued

Panel 1.3D

| Tissue Name | Rel. Exp.(%) Ag1706, Run 165532719 | Rel. Exp.(%) Ag1851, Run 165974829 | Rel. Exp.(%) Ag2544, Run 165639972 | Tissue Name | Rel. Exp.(%) Ag1706, Run 165532719 | Rel. Exp.(%) Ag1851, Run 165974829 | Rel. Exp.(%) Ag2544, Run 165639972 |
|---|---|---|---|---|---|---|---|
| Colon ca. HCT-116 | 6.7 | 0.0 | 0.0 | Testis | 25.3 | 23.5 | 52.5 |
| Colon ca. CaCo-2 | 18.0 | 5.5 | 5.7 | Melanoma Hs688(A).T | 0.0 | 8.1 | 0.0 |
| Colon ca. tissue(ODO3866) | 0.0 | 0.0 | 0.0 | Melanoma* (met) Hs688(B).T | 0.0 | 7.9 | 0.0 |
| Colon ca. HCC-2998 | 0.0 | 0.0 | 0.0 | Melanoma UACC-62 | 0.0 | 2.5 | 0.0 |
| Gastric ca.* (liver met) NCI-N87 | 48.6 | 9.3 | 40.1 | Melanoma M14 | 0.0 | 0.0 | 0.0 |
| Bladder | 9.0 | 18.2 | 0.0 | Melanoma LOX IMVI | 0.0 | 0.0 | 0.0 |
| Trachea | 0.0 | 7.9 | 14.8 | Melanoma* (met) SK-MEL-5 | 8.3 | 0.0 | 0.0 |
| Kidney | 0.0 | 38.4 | 31.6 | Adipose | 13.9 | 15.5 | 9.1 |

TABLE MF

Panel 2.2

| Tissue Name | Rel. Exp. (%) Ag1706, Run 173750214 | Rel. Exp. (%) Ag1851, Run 174148763 | Tissue Name | Rel. Exp. (%) Ag1706, Run 173750214 | Rel. Exp. (%) Ag1851, Run 174148763 |
|---|---|---|---|---|---|
| Normal Colon | 4.7 | 10.0 | Kidney Margin (OD04348) | 19.3 | 69.3 |
| Colon cancer (OD06064) | 0.0 | 8.2 | Kidney malignant cancer (OD06204B) | 4.8 | 0.0 |
| Colon Margin (OD06064) | 2.5 | 0.0 | Kidney normal adjacent tissue (OD06204E) | 0.0 | 0.0 |
| Colon cancer (OD06159) | 0.0 | 0.0 | Kidney Cancer (OD04450-01) | 49.7 | 35.4 |
| Colon Margin (OD06159) | 11.6 | 0.0 | Kidney Margin (OD04450-03) | 12.5 | 48.0 |
| Colon cancer (OD06297-04) | 0.0 | 0.0 | Kidney Cancer 8120613 | 0.0 | 0.0 |
| Colon Margin (OD06297-015) | 0.0 | 0.0 | Kidney Margin 8120614 | 0.0 | 0.0 |
| CC Gr.2 ascend colon (ODO3921) | 0.0 | 0.0 | Kidney Cancer 9010320 | 0.0 | 0.0 |
| CC Margin (ODO3921) | 4.0 | 8.8 | Kidney Margin 9010321 | 0.0 | 0.0 |
| Colon cancer metastasis (OD06104) | 0.0 | 0.0 | Kidney Cancer 8120607 | 0.0 | 0.0 |
| Lung Margin (OD06104) | 0.0 | 0.0 | Kidney Margin 8120608 | 0.0 | 9.9 |
| Colon mets to lung (OD04451-01) | 0.0 | 0.0 | Normal Uterus | 11.0 | 33.4 |
| Lung Margin (OD04451-02) | 11.4 | 11.1 | Uterine Cancer 064011 | 0.0 | 7.2 |
| Normal Prostate | 19.1 | 9.9 | Normal Thyroid | 15.1 | 0.0 |
| Prostate Cancer (OD04410) | 0.0 | 0.0 | Thyroid Cancer 064010 | 9.5 | 0.0 |
| Prostate Margin (OD04410) | 0.0 | 0.0 | Thyroid Cancer A302152 | 11.6 | 27.5 |
| Normal Ovary | 0.0 | 0.0 | Thyroid Margin A302153 | 5.3 | 24.7 |
| Ovarian cancer (OD06283-03) | 4.8 | 0.0 | Normal Breast | 30.6 | 36.1 |

TABLE MF-continued

Panel 2.2

| Tissue Name | Rel. Exp. (%) Ag1706, Run 173750214 | Rel. Exp. (%) Ag1851, Run 174148763 | Tissue Name | Rel. Exp. (%) Ag1706, Run 173750214 | Rel. Exp. (%) Ag1851, Run 174148763 |
|---|---|---|---|---|---|
| Ovarian Margin (OD06283-07) | 2.8 | 22.1 | Breast Cancer (OD04566) | 0.0 | 0.0 |
| Ovarian Cancer 064008 | 79.6 | 9.9 | Breast Cancer 1024 | 4.9 | 0.0 |
| Ovarian cancer (OD06145) | 6.8 | 10.4 | Breast Cancer (OD04590-01) | 0.0 | 9.2 |
| Ovarian Margin (OD06145) | 0.0 | 15.5 | Breast Cancer Mets (OD04590-03) | 42.0 | 26.2 |
| Ovarian cancer (OD06455-03) | 5.8 | 25.3 | Breast Cancer Metastasis (OD04655-05) | 17.3 | 42.0 |
| Ovarian Margin (OD06455-07) | 11.8 | 11.7 | Breast Cancer 064006 | 0.0 | 0.0 |
| Normal Lung | 4.8 | 11.0 | Breast Cancer 9100266 | 0.0 | 0.0 |
| Invasive poor diff. lung adeno (ODO4945-01) | 25.0 | 12.1 | Breast Margin 9100265 | 12.8 | 0.0 |
| Lung Margin (ODO4945-03) | 10.7 | 26.2 | Breast Cancer A209073 | 11.8 | 7.5 |
| Lung Malignant Cancer (OD03126) | 0.0 | 7.7 | Breast Margin A2090734 | 10.2 | 28.1 |
| Lung Margin (OD03126) | 0.0 | 0.0 | Breast cancer (OD06083) | 21.3 | 31.0 |
| Lung Cancer (OD05014A) | 5.5 | 0.0 | Breast cancer node metastasis (OD06083) | 35.8 | 31.9 |
| Lung Margin (OD05014B) | 11.9 | 8.2 | Normal Liver | 100.0 | 100.0 |
| Lung cancer (OD06081) | 19.5 | 0.0 | Liver Cancer 1026 | 0.0 | 0.0 |
| Lung Margin (OD06081) | 5.3 | 0.0 | Liver Cancer 1025 | 37.6 | 24.7 |
| Lung Cancer (OD04237-01) | 5.8 | 0.0 | Liver Cancer 6004-T | 5.3 | 11.3 |
| Lung Margin (OD04237-02) | 0.0 | 0.0 | Liver Tissue 6004-N | 6.4 | 0.0 |
| Ocular Melanoma Metastasis | 0.0 | 9.5 | Liver Cancer 6005-T | 0.0 | 5.1 |
| Ocular Melanoma Margin (Liver) | 0.0 | 8.1 | Liver Tissue 6005-N | 0.0 | 21.3 |
| Melanoma Metastasis | 0.0 | 0.0 | Liver Cancer 064003 | 14.3 | 3.9 |
| Melanoma Margin (Lung) | 5.5 | 0.0 | Normal Bladder | 0.0 | 0.0 |
| Normal Kidney | 0.0 | 23.8 | Bladder Cancer 1023 | 5.6 | 0.0 |
| Kidney Ca, Nuclear grade 2 (OD04338) | 28.1 | 57.0 | Bladder Cancer A302173 | 0.0 | 0.0 |
| Kidney Margin (OD04338) | 39.5 | 15.1 | Normal Stomach | 11.3 | 12.9 |
| Kidney Ca Nuclear grade 1/2 (OD04339) | 71.2 | 78.5 | Gastric Cancer 9060397 | 0.0 | 0.0 |
| Kidney Margin (OD04339) | 0.0 | 20.9 | Stomach Margin 9060396 | 9.2 | 0.0 |
| Kidney Ca, Clear cell type (OD04340) | 0.0 | 0.0 | Gastric Cancer 9060395 | 48.0 | 0.0 |
| Kidney Margin (OD04340) | 22.4 | 36.3 | Stomach Margin 9060394 | 7.6 | 0.0 |
| Kidney Ca, Nuclear grade 3 (OD04348) | 5.7 | 0.0 | Gastric Cancer 064005 | 0.0 | 0.0 |

TABLE MG

Panel 4D

| Tissue Name | Rel. Exp.(%) Ag1706, Run 164729527 | Rel. Exp.(%) Ag1851, Run 165831440 | Rel. Exp.(%) Ag2544, Run 164392487 | Tissue Name | Rel. Exp.(%) Ag1706, Run 164729527 | Rel. Exp.(%) Ag1851, Run 165831440 | Rel. Exp.(%) Ag2544, Run 164392487 |
|---|---|---|---|---|---|---|---|
| Secondary Th1 act | 0.0 | 0.0 | 0.0 | HUVEC IL-1beta | 0.0 | 0.0 | 0.0 |
| Secondary Th2 act | 0.8 | 2.6 | 5.2 | HUVEC IFN gamma | 5.4 | 5.5 | 9.4 |
| Secondary Tr1 act | 0.0 | 7.9 | 0.0 | HUVEC TNF alpha + IFN gamma | 0.0 | 0.0 | 3.1 |
| Secondary Th1 rest | 4.9 | 5.0 | 0.0 | HUVEC TNF alpha + IL4 | 2.8 | 0.8 | 0.0 |
| Secondary Th2 rest | 0.0 | 5.5 | 0.0 | HUVEC IL-11 | 4.5 | 1.5 | 0.0 |
| Secondary Tr1 rest | 4.2 | 4.4 | 7.1 | Lung Microvascular EC none | 1.4 | 2.8 | 14.4 |
| Primary Th1 act | 3.3 | 1.2 | 0.0 | Lung Microvascular EC TNFalpha + IL-1beta | 2.8 | 4.4 | 9.0 |
| Primary Th2 act | 1.1 | 4.0 | 0.0 | Microvascular Dermal EC none | 1.1 | 1.6 | 13.5 |
| Primary Tr1 act | 4.3 | 0.8 | 0.0 | Microvascular Dermal EC TNFalpha + IL-1beta | 0.0 | 2.6 | 0.0 |
| Primary Th1 rest | 13.4 | 22.1 | 36.9 | Bronchial epithelium TNFalpha + IL1beta | 9.3 | 5.5 | 7.7 |
| Primary Th2 rest | 15.5 | 13.6 | 41.2 | Small airway epithelium none | 3.4 | 2.1 | 0.0 |
| Primary Tr1 rest | 6.6 | 12.1 | 10.4 | Small airway epithelium TNFalpha + IL-1beta | 10.0 | 24.8 | 60.7 |
| CD45RA CD4 lymphocyte act | 0.7 | 0.4 | 8.7 | Coronery artery SMC rest | 1.3 | 1.6 | 3.4 |
| CD45RO CD4 lymphocyte act | 13.2 | 4.9 | 2.8 | Coronery artery SMC TNFalpha + IL-1beta | 3.5 | 2.2 | 0.0 |
| CD8 lymphoctye act | 10.3 | 8.2 | 13.4 | Astrocytes rest | 0.0 | 9.5 | 0.0 |
| Secondary CD8 lymphocyte rest | 1.9 | 7.1 | 16.7 | Astrocytes TNFalpha + IL-1beta | 2.8 | 19.9 | 13.0 |
| Secondary CD8 lymphoctye act | 3.5 | 6.7 | 0.0 | KU-812 (Basophil) rest | 5.4 | 11.8 | 17.0 |
| CD4 lymphocyte none | 6.0 | 4.3 | 13.1 | KU-812 (Basophil) PMA/ionomycin | 18.4 | 23.8 | 36.6 |
| 2ry Th1/Th2/Tr1_anti-CD95 CH11 | 5.6 | 18.7 | 13.0 | CCD1106 (Keratinocytes) none | 10.4 | 26.1 | 46.7 |
| LAK cells rest | 7.9 | 7.1 | 14.0 | CCD1106 (Keratinocytes) TNFalpha + IL-1beta | 9.7 | 100.0 | 10.7 |
| LAK cells IL-2 | 0.0 | 15.5 | 4.2 | Liver cirrhosis | 6.1 | 18.4 | 10.0 |
| LAk cells IL-2 + IL-12 | 8.0 | 15.9 | 11.3 | Lupus kidney | 2.7 | 27.9 | 13.6 |
| LAK cells IL-2 + IFN gamma | 21.2 | 20.7 | 77.9 | NCI-H292 none | 11.6 | 5.1 | 20.0 |
| LAK cells IL-2 + IL-18 | 66.9 | 22.5 | 25.9 | NCI-H292 IL-4 | 8.8 | 14.0 | 27.4 |
| LAK cells PMA/ionomycin | 1.4 | 0.0 | 0.0 | NCI-H292 IL-9 | 4.5 | 6.9 | 39.8 |
| NK Cells IL-2 rest | 9.7 | 7.1 | 11.7 | NCI-H292 IL-13 | 0.0 | 6.9 | 0.0 |
| Two Way MLR 3 day | 10.4 | 20.2 | 40.3 | NCI-H292 IFN gamma | 2.8 | 5.0 | 7.8 |
| Two Way MLR 5 day | 3.8 | 7.0 | 0.0 | HPAEC none | 5.7 | 3.2 | 4.0 |

TABLE MG-continued

Panel 4D

| Tissue Name | Rel. Exp.(%) Ag1706, Run 164729527 | Rel. Exp.(%) Ag1851, Run 165831440 | Rel. Exp.(%) Ag2544, Run 164392487 | Tissue Name | Rel. Exp.(%) Ag1706, Run 164729527 | Rel. Exp.(%) Ag1851, Run 165831440 | Rel. Exp.(%) Ag2544, Run 164392487 |
|---|---|---|---|---|---|---|---|
| Two Way MLR 7 day | 0.0 | 0.8 | 3.7 | HPAEC TNF alpha + IL-1 beta | 0.0 | 2.6 | 0.0 |
| PBMC rest | 0.1 | 2.5 | 2.9 | Lung fibroblast none | 4.5 | 6.1 | 0.0 |
| PBMC PWM | 20.6 | 6.0 | 19.2 | Lung fibroblast TNF alpha + IL-1 beta | 0.0 | 3.9 | 0.0 |
| PBMC PHA-L | 11.6 | 1.5 | 4.1 | Lung fibroblast IL-4 | 0.0 | 2.9 | 0.0 |
| Ramos (B cell) none | 10.4 | 25.9 | 61.6 | Lung fibroblast IL-9 | 1.3 | 3.3 | 8.1 |
| Ramos (B cell) ionomycin | 100.0 | 28.9 | 100.0 | Lung fibroblast IL-13 | 6.5 | 0.0 | 0.0 |
| B lymphocytes PWM | 14.1 | 4.1 | 13.5 | Lung fibroblast IFN gamma | 5.0 | 3.1 | 15.9 |
| B lymphocytes CD40L and IL-4 | 31.0 | 6.0 | 18.6 | Dermal fibroblast CCD1070 rest | 27.9 | 3.6 | 14.0 |
| EOL-1 dbcAMP | 2.0 | 0.0 | 0.0 | Dermal fibroblast CCD1070 TNF alpha | 17.0 | 9.6 | 11.2 |
| EOL-1 dbcAMP PMA/ionomycin | 0.0 | 0.0 | 0.0 | Dermal fibroblast CCD1070 IL-1 beta | 1.4 | 0.0 | 6.3 |
| Dendritic cells none | 4.2 | 3.9 | 24.7 | Dermal fibroblast IFN gamma | 6.8 | 1.6 | 9.4 |
| Dendritic cells LPS | 1.2 | 3.7 | 17.6 | Dermal fibroblast IL-4 | 3.9 | 5.1 | 14.5 |
| Dendritic cells anti-CD40 | 2.9 | 1.4 | 3.1 | IBD Colitis 2 | 1.7 | 11.7 | 3.1 |
| Monocytes rest | 0.7 | 4.9 | 0.0 | IBD Crohn's | 0.0 | 3.1 | 0.0 |
| Monocytes LPS | 2.6 | 15.9 | 16.0 | Colon | 9.1 | 8.0 | 10.0 |
| Macrophages rest | 6.6 | 11.0 | 21.9 | Lung | 1.4 | 3.2 | 8.7 |
| Macrophages LPS | 1.4 | 2.1 | 0.0 | Thymus | 31.4 | 30.6 | 50.0 |
| HUVEC none | 1.6 | 2.3 | 0.0 | Kidney | 10.4 | 40.9 | 55.1 |
| HUVEC starved | 2.2 | 4.6 | 21.6 | | | | |

TABLE MH

Panel CNS_1

| Tissue Name | Rel. Exp. (%) Ag1851, Run 171628439 | Tissue Name | Rel. Exp. (%) Ag1851, Run 171628439 |
|---|---|---|---|
| BA4 Control | 31.9 | BA17 PSP | 18.7 |
| BA4 Control2 | 62.9 | BA17 PSP2 | 7.3 |
| BA4 Alzheimer's2 | 0.0 | Sub Nigra Control | 10.2 |
| BA4 Parkinson's | 75.8 | Sub Nigra Control2 | 26.4 |
| BA4 Parkinson's2 | 100.0 | Sub Nigra Alzheimer's2 | 6.9 |
| BA4 Huntington's | 13.3 | Sub Nigra Parkinson's2 | 12.6 |
| BA4 Huntington's2 | 0.0 | Sub Nigra Huntington's | 34.6 |
| BA4 PSP | 26.8 | Sub Nigra Huntington's2 | 32.8 |
| BA4 PSP2 | 40.9 | Sub Nigra PSP2 | 8.2 |
| BA4 Depression | 39.8 | Sub Nigra Depression | 17.1 |
| BA4 Depression2 | 8.2 | Sub Nigra Depression2 | 16.0 |

TABLE MH-continued

Panel CNS_1

| Tissue Name | Rel. Exp. (%) Ag1851, Run 171628439 | Tissue Name | Rel. Exp. (%) Ag1851, Run 171628439 |
|---|---|---|---|
| BA7 Control | 38.7 | Glob Palladus Control | 15.8 |
| BA7 Control2 | 0.0 | Glob Palladus Control2 | 15.9 |
| BA7 Alzheimer's2 | 22.8 | Glob Palladus Alzheimer's | 0.0 |
| BA7 Parkinson's | 18.8 | Glob Palladus Alzheimer's2 | 0.0 |
| BA7 Parkinson's2 | 55.1 | Glob Palladus Parkinson's | 57.8 |
| BA7 Huntington's | 32.1 | Glob Palladus Parkinson's2 | 8.7 |
| BA7 Huntington's2 | 10.8 | Glob Palladus PSP | 21.3 |
| BA7 PSP | 54.0 | Glob Palladus PSP2 | 0.0 |
| BA7 PSP2 | 9.1 | Glob Palladus Depression | 0.0 |
| BA7 Depression | 8.3 | Temp Pole Control | 0.0 |
| BA9 Control | 0.0 | Temp Pole Control2 | 41.2 |
| BA9 Control2 | 8.7 | Temp Pole Alzheimer's | 0.0 |
| BA9 Alzheimer's | 0.0 | Temp Pole Alzheimer's2 | 8.3 |
| BA9 Alzheimer's2 | 17.1 | Temp Pole Parkinson's | 32.3 |
| BA9 Parkinson's | 17.9 | Temp Pole Parkinson's2 | 14.8 |
| BA9 Parkinson's2 | 32.5 | Temp Pole Huntington's | 7.4 |
| BA9 Huntington's | 11.7 | Temp Pole PSP | 11.2 |
| BA9 Huntington's2 | 0.0 | Temp Pole PSP2 | 0.0 |
| BA9 PSP | 15.8 | Temp Pole Depression2 | 8.9 |
| BA9 PSP2 | 0.0 | Cing Gyr Control | 35.8 |
| BA9 Depression | 0.0 | Cing Gyr Control2 | 16.8 |
| BA9 Depression2 | 18.4 | Cing Gyr Alzheimer's | 7.5 |
| BA17 Control | 17.3 | Cing Gyr Alzheimer's2 | 23.3 |
| BA17 Control2 | 40.6 | Cing Gyr Parkinson's | 15.7 |
| BA17 Alzheimer's2 | 0.0 | Cing Gyr Parkinson's2 | 17.9 |
| BA17 Parkinson's | 43.8 | Cing Gyr Huntington's | 40.1 |
| BA17 Parkinson's2 | 15.9 | Cing Gyr Huntington's2 | 20.9 |
| BA17 Huntington's | 37.1 | Cing Gyr PSP | 30.4 |
| BA17 Huntington's2 | 6.5 | Cing Gyr PSP2 | 18.7 |
| BA17 Depression | 0.0 | Cing Gyr Depression | 24.1 |
| BA17 Depression2 | 8.7 | Cing Gyr Depression2 | 17.6 |

CNS_neurodegeneration_v1.0 Summary: Ag1851/Ag2544 Two experiments with two different probe and primer sets both show significant expression of the AL359846_A_da1 gene in the brain. While no specific association with Alzheimer's disease is evident from the results of these experiments, the expression of this GPCR homolog in the brain is confirmed. Please see Panel 1.3D for discussion of potential utility in the central nervous system.

Panel 1.3D Summary: Ag1706/Ag1851/Ag2544 Three experiments with two different probe and primer sets show significant expression of the AL359846_A_da1 gene, which encodes a novel G-protein coupled receptor (GPCR), in the brain. The GPCR family of receptors contains a large number of neurotransmitter receptors, including the dopamine, serotonin, a and b-adrenergic, acetylcholine muscarinic, histamine, peptide, and metabotropic glutamate receptors. GPCRs are excellent drug targets in various neurologic and psychiatric diseases. All antipsychotics have been shown to act at the dopamine D2 receptor; similarly novel antipsychotics also act at the serotonergic receptor, and often the muscarinic and adrenergic receptors as well. While the majority of antidepressants can be classified as selective serotonin reuptake inhibitors, blockade of the 5-HT1A and a2 adrenergic receptors increases the effects of these drugs.

The GPCRs are also of use as drug targets in the treatment of stroke. Blockade of the glutamate receptors may decrease the neuronal death resulting from excitotoxicity; furthermore the purinergic receptors have also been implicated as drug targets in the treatment of cerebral ischemia. The b-adrenergic receptors have been implicated in the treatment of ADHD with Ritalin, while the a-adrenergic receptors have been implicated in memory. Therefore this gene may be of use as a small molecule target for the treatment of any of the described diseases.

REFERENCES

El Yacoubi M, Ledent C, Parmentier M, Bertorelli R, Ongini E, Costentin J, Vaugeois J M. Adenosine A2A receptor antagonists are potential antidepressants: evidence based on pharmacology and A2A receptor knockout mice. Br J Pharmacol 2001 September; 134(1):68–77 1. Adenosine, an ubiquitous neuromodulator, and its analogues have been shown to produce 'depressant' effects in animal models believed to be relevant to depressive disorders, while adenosine receptor antagonists have been found to reverse adenosine-mediated 'depressant' effect. 2. We have designed studies to assess whether adenosine A2A receptor antagonists, or genetic inactivation of the receptor would be effective in established screening procedures, such as tail suspension and forced swim tests, which are predictive of clinical antidepressant activity. 3. Adenosine A2A receptor knockout mice were found to be less sensitive to 'depressant' challenges than their wild-type littermates. Consistently, the adenosine A2A receptor blockers SCH 58261 (1–10 mg kg(−1), i.p.) and KW 6002 (0.1–10 mg kg(−1), p.o.) reduced the total immobility time in the tail suspension test. 4. The efficacy of adenosine A2A receptor antagonists in reducing immobility time in the tail suspension test was confirmed and extended in two groups of mice. Specifically, SCH 58261 (1–10 mg kg(−1)) and ZM 241385 (15–60 mg kg(−1)) were effective in mice previously screened for having high immobility time, while SCH 58261 at 10 mg kg(−1) reduced immobility of mice that were selectively bred for their spontaneous 'helplessness' in this assay. 5. Additional experiments were carried out using the forced swim test. SCH 58261 at 10 mg kg(−1) reduced the immobility time by 61%, while KW 6002 decreased the total immobility time at the doses of 1 and 10 mg kg(−1) by 75 and 79%, respectively. 6. Administration of the dopamine D2 receptor antagonist haloperidol (50–200 microg kg(−1) i.p.) prevented the antidepressant-like effects elicited by SCH 58261 (10 mg kg(−1) i.p.) in forced swim test whereas it left unaltered its stimulant motor effects. 7. In conclusion, these data support the hypothesis that A2A receptor antagonists prolong escape-directed behaviour in two screening tests for antidepressants. Altogether the results support the hypothesis that blockade of the adenosine A2A receptor might be an interesting target for the development of effective antidepressant agents.

Blier P. Pharmacology of rapid-onset antidepressant treatment strategies. Clin Psychiatry 2001; 62 Suppl 15:12–7

Although selective serotonin reuptake inhibitors (SSRIs) block serotonin (5-HT) reuptake rapidly, their therapeutic action is delayed. The increase in synaptic 5-HT activates feedback mechanisms mediated by 5-HT1A (cell body) and 5-HT1B (terminal) autoreceptors, which, respectively, reduce the firing in 5-HT neurons and decrease the amount of 5-HT released per action potential resulting in attenuated 5-HT neurotransmission. Long-term treatment desensitizes the inhibitory 5-HT1 autoreceptors, and 5-HT neurotransmission is enhanced. The time course of these events is similar to the delay of clinical action. The addition of pindolol, which blocks 5-HT1A receptors, to SSRI treatment decouples the feedback inhibition of 5-HT neuron firing and accelerates and enhances the antidepressant response. The neuronal circuitry of the 5-HT and norepinephrine (NE) systems and their connections to forebrain areas believed to be involved in depression has been dissected. The firing of 5-HT neurons in the raphe nuclei is driven, at least partly, by alpha1-adrenoceptor-mediated excitatory inputs from NE neurons. Inhibitory alpha2-adrenoceptors on the NE neuroterminals form part of a feedback control mechanism. Mirtazapine, an antagonist at alpha2-adrenoceptors, does not enhance 5-HT neurotransmission directly but disinhibits the NE activation of 5-HT neurons and thereby increases 5-HT neurotransmission by a mechanism that does not require a time-dependent desensitization of receptors. These neurobiological phenomena may underlie the apparently faster onset of action of mirtazapine compared with the SSRIs.

Tranquillini M E, Reggiani A. Glycine-site antagonists and stroke. Expert Opin Investig Drugs 1999 November; 8(11):1837–1848

The excitatory amino acid, (S)-glutamic acid, plays an important role in controlling many neuronal processes. Its action is mediated by two main groups of receptors: the ionotropic receptors (which include NMDA, AMPA and kainic acid subtypes) and the metabotropic receptors (mGluR(1–8)) mediating G-protein coupled responses. This review focuses on the strychnine insensitive glycine binding site located on the NMDA receptor channel, and on the possible use of selective antagonists for the treatment of stroke. Stroke is a devastating disease caused by a sudden vascular accident. Neurochemically, a massive release of glutamate occurs in neuronal tissue; this overactivates the NMDA receptor, leading to increased intracellular calcium influx, which causes neuronal cell death through necrosis. NMDA receptor activation strongly depends upon the presence of glycine as a co-agonist. Therefore, the administration of a glycine antagonist can block overactivation of NMDA receptors, thus preserving neurones from damage. The glycine antagonists currently identified can be divided into five main categories depending on their chemical structure: indoles, tetrahydroquinolines, benzoazepines, quinoxalinediones and pyrida-zinoquinolines.

Monopoli A, Lozza G, Forlani A, Mattavelli A, Ongini E. Blockade of adenosine A2A receptors by SCH 58261 results in neuroprotective effects in cerebral ischaemia in rats. Neuroreport 1998 Dec. 1; 9(17):3955–9Related Articles, Books, LinkOut Blockade of adenosine receptors can reduce cerebral infarct size in the model of global ischaemia. Using the potent and selective A2A adenosine receptor antagonist, SCH 58261, we assessed whether A2A receptors are involved in the neuronal damage following focal cerebral ischaemia as induced by occluding the left middle cerebral artery. SCH 58261 (0.01 mg/kg either i.p. or i.v.) administered to normotensive rats 10 min after ischaemia markedly reduced cortical infarct volume as measured 24 h later (30% vs controls, p<0.05). Similar effects were observed when SCH 58261 (0.01 mg/kg, i.p.) was administered to hypertensive rats (28% infarct volume reduction vs controls, p<0.05). Neuroprotective properties of SCH 58261 administered after ischaemia indicate that blockade of A2A adenosine receptors is a potentially useful biological target for the reduction of brain injury.

Panel 2.2 Summary: Ag1706/Ag1851 Results from two experiments using the identical probe/primer set are in reasonable agreement. Expression of the AL359846_A_da1 gene is highest in a normal liver sample. Lower levels of expression are also seen in several kidney and breast samples, both from tumor and normal adjacent tissue. Therefore, expression of this gene may be used to distinguish liver, kidney and breast from the other samples on this panel.

Panel 4D Summary: Ag1706/1851/2544: Results from three experiments are in reasonable agreement. Expression of the AL359846_A_da1 gene is detected in LAK cells, Ramos B cells, thymus and kidney. Expression does not appear to be dependent upon activation in the cell types tested. The expression of the transcript may be dependent upon the proliferation status of cells, since it is expressed in specific types of proliferating cells including LAK cells, B cells and cells in the thymus and kidney. Thus, the transcript or the protein it encodes may be important for detecting LAK cells or thymic and kidney tissue.

Panel CNS_1 Summary: Ag1851 The results of this experiment further confirm the expression of the AL359846_A_da1 gene in the brain. Please see Panel 1.3D for discussion of potential utility in the central nervous system.

NOV19 a and NOV19b: CG56574-01 and CG56574-02: Dystrophin

Expression of gene CG56574-01 and variant CG565724-02 was assessed using the primer-probe set Ag1409, described in Table NA. Results of the RTQ-PCR runs are shown in Table NB.

TABLE NA

Probe Name Ag1409

| Primers | Sequences | Length | Start Position |
|---|---|---|---|
| Forward | 5'-agcattactgccaaagtttgaa-3' (SEQ ID NO: 416) | 22 | 1414 |
| Probe | TET-5'-cctcgtagtcctgcccagatcttgat-3'-TAMRA (SEQ ID NO: 417) | 26 | 1458 |
| Reverse | 5'-cccctctttcctcactctaa-3' (SEQ ID NO: 418) | 22 | 1488 |

TABLE NB

Panel 1.2

| Tissue Name | Rel. Exp. (%) Ag1409, Run 138249588 | Tissue Name | Rel. Exp. (%) Ag1409, Run 138249588 |
|---|---|---|---|
| Endothelial cells | 0.4 | Renal ca. 786-0 | 0.7 |
| Heart (Fetal) | 4.3 | Renal ca. A498 | 0.6 |
| Pancreas | 0.9 | Renal ca. RXF 393 | 0.4 |
| Pancreatic ca. CAPAN 2 | 0.0 | Renal ca. ACHN | 1.1 |
| Adrenal Gland | 8.8 | Renal ca. UO-31 | 0.9 |
| Thyroid | 0.1 | Renal ca. TK-10 | 0.7 |
| Salivary gland | 12.9 | Liver | 13.4 |
| Pituitary gland | 0.3 | Liver (fetal) | 2.0 |
| Brain (fetal) | 0.2 | Liver ca. (hepatoblast) HepG2 | 5.1 |
| Brain (whole) | 0.7 | Lung | 0.1 |
| Brain (amygdala) | 1.8 | Lung (fetal) | 0.6 |
| Brain (cerebellum) | 0.8 | Lung ca. (small cell) LX-1 | 0.4 |
| Brain (hippocampus) | 5.2 | Lung ca. (small cell) NCI-H69 | 0.7 |
| Brain (thalamus) | 2.6 | Lung ca. (s.cell var.) SHP-77 | 1.2 |
| Cerebral Cortex | 12.0 | Lung ca. (large cell)NCI-H460 | 1.4 |
| Spinal cord | 0.7 | Lung ca. (non-sm. cell) A549 | 0.0 |
| glio/astro U87-MG | 0.1 | Lung ca. (non-s.cell) NCI-H23 | 6.7 |
| glio/astro U-118-MG | 0.3 | Lung ca. (non-s.cell) HOP-62 | 2.0 |
| astrocytoma SW1783 | 1.1 | Lung ca. (non-s.cl) NCI-H522 | 0.0 |
| neuro*; met SK-N-AS | 0.4 | Lung ca. (squam.) SW 900 | 0.0 |
| astrocytoma SF-539 | 0.3 | Lung ca. (squam.) NCI-H596 | 1.3 |
| astrocytoma SNB-75 | 1.2 | Mammary gland | 1.7 |
| glioma SNB-19 | 4.3 | Breast ca.* (pl.ef) MCF-7 | 0.4 |
| glioma U251 | 2.4 | Breast ca.* (pl.ef) MDA-MB-231 | 0.0 |
| glioma SF-295 | 0.1 | Breast ca.* (pl. ef) T47D | 0.6 |
| Heart | 57.4 | Breast ca. BT-549 | 1.3 |
| Skeletal Muscle | 100.0 | Breast ca. MDA-N | 0.7 |
| Bone marrow | 0.3 | Ovary | 4.7 |
| Thymus | 0.1 | Ovarian ca. OVCAR-3 | 1.0 |
| Spleen | 0.2 | Ovarian ca. OVCAR-4 | 1.4 |
| Lymph node | 0.1 | Ovarian ca. OVCAR-5 | 1.2 |
| Colorectal Tissue | 1.1 | Ovarian ca. OVCAR-8 | 1.2 |
| Stomach | 0.9 | Ovarian ca. IGROV-1 | 0.0 |
| Small intestine | 6.8 | Ovarian ca. (ascites) SK-OV-3 | 0.4 |
| Colon ca. SW480 | 0.0 | Uterus | 2.5 |
| Colon ca.* SW620 (SW480 met) | 0.0 | Placenta | 0.2 |
| Colon ca. HT29 | 0.0 | Prostate | 3.7 |
| Colon ca. HCT-116 | 0.0 | Prostate ca.* (bone met) PC-3 | 0.0 |
| Colon ca. CaCo-2 | 3.1 | Testis | 0.2 |
| Colon ca. Tissue (ODO3866) | 0.4 | Melanoma Hs688(A).T | 0.2 |
| Colon ca. HCC-2998 | 0.0 | Melanoma* (met) Hs688(B).T | 1.0 |
| Gastric ca.* (liver met) NCI-N87 | 0.0 | Melanoma UACC-62 | 0.5 |
| Bladder | 7.9 | Melanoma M14 | 0.4 |
| Trachea | 0.3 | Melanoma LOX IMVI | 0.0 |
| Kidney | 6.1 | Melanoma* (met) SK-MEL-5 | 3.9 |
| Kidney (fetal) | 1.0 | | |

Panel 1.2 Summary: Ag1409 The CG56574-01 gene has moderate levels of expression (CT values=28–31) in pancreas, thyroid and pituitary. This gene is highly expressed (CT values=22–27) in adult and fetal heart, adult and fetal liver, and adrenal gland. This widespread expression in tissues with metabolic function suggests that this putative cytoskeletal protein may be important for the pathogenesis, diagnosis, and/or treatment of metabolic diseases including obesity and Types 1 and 2 diabetes.

This gene is also expressed at moderate to high levels in most cancer cells in this panel. Thus, this gene may be involved in cell structure, binding to glycoproteins associated with the cell membrane. Hence, this gene would be required for cell survival and proliferation.

In addition, this gene, a homolog of dystrophin, is expressed at high levels in the CNS and skeletal muscle. Dystrophin is associated with major Duchenne muscular dystrophy. Thus, therapeutic modulation of this gene or its protein product may be of clinical benefit in the treatment of muscular dystrophy.

NOV21: CG56500-01: TFIIIC Box B-Binding Subunit

Expression of gene CG56500-01 was assessed using the primer-probe set Ag4856, described in Table OA. Results of the RTQ-PCR runs are shown in Table OB.

TABLE OA

Probe Name Ag4856

| Primers | Sequences | Length | Start Position |
|---|---|---|---|
| Forward | 5'-ctgctgatgaggggctactac-3' (SEQ ID NO: 419) | 21 | 4996 |
| Probe | TET-5'-aacctcaaccccaacgacagcattgt-3'-TAMRA (SEQ ID NO: 420) | 26 | 5041 |
| Reverse | 5'-gaacttcatctggcaggagtt-3' (SEQ ID NO: 421) | 21 | 5071 |

TABLE OB

General_screening_panel_v1.5

| Tissue Name | Rel. Exp.(%) Ag4856, Run 228888064 | Tissue Name | Rel. Exp.(%) Ag4856, Run 228888064 |
|---|---|---|---|
| Adipose | 7.6 | Renal ca. TK-10 | 35.4 |
| Melanoma* Hs688(A).T | 33.7 | Bladder | 16.5 |
| Melanoma* Hs688(B).T | 39.0 | Gastric ca. (liver met.) NCI-N87 | 71.7 |
| Melanoma* M14 | 59.5 | Gastric ca. KATO III | 82.4 |
| Melanoma* LOXIMVI | 36.9 | Colon ca. SW-948 | 14.4 |
| Melanoma* SK-MEL-5 | 28.5 | Colon ca. SW480 | 68.3 |
| Squamous cell carcinoma SCC-4 | 27.2 | Colon ca.* (SW480 met) SW620 | 61.6 |
| Testis Pool | 14.3 | Colon ca. HT29 | 16.4 |
| Prostate ca.* (bone met) PC-3 | 47.6 | Colon ca. HCT-116 | 100.0 |
| Prostate Pool | 27.4 | Colon ca. CaCo-2 | 49.0 |
| Placenta | 13.4 | Colon cancer tissue | 25.2 |
| Uterus Pool | 11.2 | Colon ca. SW1116 | 16.8 |
| Ovarian ca. OVCAR-3 | 41.5 | Colon ca. Colo-205 | 13.0 |
| Ovarian ca.SK-OV-3 | 68.8 | Colon ca. SW-48 | 16.4 |
| Ovarian ca. OVCAR-4 | 57.8 | Colon Pool | 21.3 |
| Ovarian ca. OVCAR-5 | 56.3 | Small Intestine Pool | 18.0 |
| Ovarian ca. IGROV-1 | 18.3 | Stomach Pool | 11.2 |
| Ovarian ca. OVCAR-8 | 27.0 | Bone Marrow Pool | 10.6 |
| Ovary | 15.3 | Fetal Heart | 16.6 |
| Breast ca. MCF-7 | 44.4 | Heart Pool | 13.3 |
| Breast ca. MDA-MB-231 | 32.8 | Lymph Node Pool | 29.1 |
| Breast ca. BT 549 | 34.6 | Fetal Skeletal Muscle | 11.4 |
| Breast ca. T47D | 21.9 | Skeletal Muscle Pool | 28.7 |
| Breast ca. MDA-N | 21.9 | Spleen Pool | 7.9 |
| Breast Pool | 22.5 | Thymus Pool | 27.2 |
| Trachea | 16.3 | CNS cancer (glio/astro) U87-MG | 20.2 |
| Lung | 3.4 | CNS cancer (glio/astro) U-118-MG | 59.5 |
| Fetal Lung | 45.7 | CNS cancer (neuro;met) SK-N-AS | 49.7 |
| Lung ca. NCI-N417 | 9.8 | CNS cancer (astro) SF-539 | 47.6 |
| Lung ca. LX-1 | 56.3 | CNS cancer (astro) SNB-75 | 91.4 |
| Lung ca. NCI-H146 | 18.2 | CNS cancer (glio) SNB-19 | 25.7 |
| Lung ca. SHP-77 | 29.1 | CNS cancer (glio) SF-295 | 95.3 |
| Lung ca. A549 | 27.7 | Brain (Amygdala) Pool | 16.3 |
| Lung ca. NCI-H526 | 24.1 | Brain (cerebellum) | 40.3 |
| Lung ca. NCI-H23 | 48.0 | Brain (fetal) | 33.4 |
| Lung ca. NCI-H460 | 27.5 | Brain (Hippocampus) Pool | 17.7 |
| Lung ca. HOP-62 | 21.6 | Cerebral Cortex Pool | 23.5 |
| Lung ca. NCI-H522 | 36.3 | Brain (Substantia nigra) Pool | 15.5 |
| Liver | 2.0 | Brain (Thalamus) Pool | 29.3 |
| Fetal Liver | 16.8 | Brain (whole) | 28.3 |
| Liver ca. HepG2 | 26.1 | Spinal Cord Pool | 4.3 |
| Kidney Pool | 33.9 | Adrenal Gland | 27.9 |
| Fetal Kidney | 16.6 | Pituitary gland Pool | 16.0 |
| Renal ca. 786-0 | 57.4 | Salivary Gland | 6.1 |
| Renal ca. A498 | 23.2 | Thyroid (female) | 20.7 |
| Renal ca. ACHN | 51.1 | Pancreatic ca. CAPAN2 | 40.9 |
| Renal ca. UO-31 | 54.0 | Pancreas Pool | 28.7 |

General_screening_panel_v1.5 Summary: Ag4856 This gene, which represents a novel transcription factor, is expressed ubiquitously in this panel, with highest expression in a colon cancer cell line (CT=26). This expression profile suggests that the gene product may be required for cell growth and proliferation and is required for tumor growth.

This gene is also expressed at low-to-moderate levels in many metabolic tisssues including adipose, adult and fetal liver, heart, and skeletal muscle, adrenal, pituitary, and pancreas. This gene product represents a novel transcription factor and is an excellent drug target for metabolic and endocrine diseases, including obesity and Types 1 and 2 diabetes.

Among tissues originating in the CNS, this gene is expressed at moderate levels. Because this gene encodes a putative transcription factore, this gene is an excellent drug target for neurological diseases in which transcription of a disease protein (e.g., Huntington's disease) is believed to be central to the progression of the disease.

NOV22: CG56475-01: Nucleoside Diphosphate Kinase B

Expression of gene CG56475-01 was assessed using the primer-probe set Ag2946, described in Table PA. Results of the RTQ-PCR runs are shown in Table PB.

TABLE PA

Probe Name Ag2946

| Primers | Sequences | Length | Start Position |
|---|---|---|---|
| Forward | 5'-gaccaattcattgggctctat-3' (SEQ ID NO: 422) | 21 | 284 |
| Probe | TET-5'-ctattattcgcagggacttctgcgct-3'-TAMRA (SEQ ID NO: 423) | 26 | 313 |
| Reverse | 5'-atgacgttcccgcctattt-3' (SEQ ID NO: 424) | 19 | 340 |

TABLE PB

Panel 4D

| Tissue Name | Rel. Exp. (%) Ag2946, Run 164403318 | Tissue Name | Rel. Exp. (%) Ag2946, Run 164403318 |
|---|---|---|---|
| Secondary Th1 act | 0.1 | HUVEC IL-1beta | 0.0 |
| Secondary Th2 act | 0.0 | HUVEC IFN gamma | 0.0 |
| Secondary Tr1 act | 0.0 | HUVEC TNF alpha + IFN gamma | 0.0 |
| Secondary Th1 rest | 0.1 | HUVEC TNF alpha + IL4 | 0.0 |
| Secondary Th2 rest | 0.0 | HUVEC IL-11 | 0.0 |
| Secondary Tr1 rest | 0.0 | Lung Microvascular EC none | 0.0 |
| Primary Th1 act | 0.0 | Lung Microvascular EC TNFalpha + IL-1beta | 0.0 |
| Primary Th2 act | 0.0 | Microvascular Dermal EC none | 0.0 |
| Primary Tr1 act | 0.0 | Microsvasular Dermal EC TNFalpha + IL-1beta | 0.0 |
| Primary Th1 rest | 0.1 | Bronchial epithelium TNFalpha + IL1beta | 0.0 |
| Primary Th2 rest | 0.0 | Small airway epithelium none | 0.0 |
| Primary Tr1 rest | 0.0 | Small airway epithelium TNFalpha + IL-1beta | 0.0 |
| CD45RA CD4 lymphocyte act | 0.0 | Coronery artery SMC rest | 0.1 |
| CD45RO CD4 lymphocyte act | 0.1 | Coronery artery SMC TNFalpha + IL-1beta | 0.0 |
| CD8 lymphocyte act | 0.0 | Astrocytes rest | 0.0 |
| Secondary CD8 lymphocyte rest | 0.0 | Astrocytes TNFalpha + IL-1beta | 0.0 |
| Secondary CD8 lymphocyte act | 0.0 | KU-812 (Basophil) rest | 0.0 |
| CD4 lymphocyte none | 0.0 | KU-812 (Basophil) PMA/ionomycin | 0.0 |
| 2ry Th1/Th2/Tr1_anti-CD95 CH11 | 0.0 | CCD1106 (Keratinocytes) none | 0.0 |
| LAK cells rest | 0.3 | CCD1106 (Keratinocytes) TNFalpha + IL-1beta | 0.0 |
| LAK cells IL-2 | 0.0 | Liver cirrhosis | 0.7 |
| LAK cells IL-2 + IL-12 | 0.0 | Lupus kidney | 0.0 |
| LAK cells IL-2 + IFN gamma | 0.0 | NCI-H292 none | 0.0 |
| LAK cells IL-2 + IL-18 | 0.0 | NCI-H292 IL4 | 0.0 |
| LAK cells PMA/ionomycin | 0.4 | NCI-H292 IL-9 | 0.0 |
| NK Cells IL-2 rest | 0.0 | NCI-H292 IL-13 | 0.0 |
| Two Way MLR 3 day | 0.0 | NCI-H292 IFN gamma | 0.0 |
| Two Way MLR 5 day | 0.0 | HPAEC none | 0.0 |
| Two Way MLR 7 day | 0.0 | HPAEC TNF alpha + IL-1 beta | 0.2 |
| PBMC rest | 0.0 | Lung fibroblast none | 0.0 |
| PBMC PWM | 0.3 | Lung fibroblast TNF alpha + IL-1 beta | 0.2 |
| PBMC PHA-L | 0.3 | Lung fibroblast IL-4 | 0.0 |
| Ramos (B cell) none | 36.3 | Lung fibroblast IL-9 | 0.0 |
| Ramos (B cell) ionomycin | 100.0 | Lung fibroblast IL-13 | 0.0 |
| B lymphocytes PWM | 2.2 | Lung fibroblast IFN gamma | 0.0 |
| B lymphocytes CD40L and IL-4 | 14.0 | Dermal fibroblast CCD1070 rest | 0.0 |
| EOL-1 dbcAMP | 0.1 | Dermal fibroblast CCD1070 TNF alpha | 0.0 |
| EOL-1 dbcAMP PMA/ionomycin | 0.0 | Dermal fibroblast CCD1070 IL-1 beta | 0.0 |
| Dendritic cells none | 0.0 | Dermal fibroblast IFN gamma | 0.0 |
| Dendritic cells LPS | 0.0 | Dermal fibroblast IL-4 | 0.0 |
| Dendritic cells anti-CD40 | 0.0 | IBD Colitis 2 | 0.0 |
| Monocytes rest | 0.0 | IBD Crohn's | 0.0 |
| Monocytes LPS | 0.0 | Colon | 0.3 |
| Macrophages rest | 0.0 | Lung | 0.0 |
| Macrophages LPS | 0.0 | Thymus | 0.4 |
| HUVEC none | 0.0 | Kidney | 0.3 |
| HUVEC starved | 0.0 | | |

CNS_neurodegeneration_v1.0 Summary: Ag2946 Expression of the CG56475-01 gene is low/undetectable in all samples on this panel (CTs>35).

Panel 1.3D Summary: Ag2946 Expression of the CG56475-01 gene is low/undetectable in all samples on this panel (CTs>35).

Panel 4D Summary: Ag2946 Expression of the CG56475-01 transcript is exclusive to B cells and a B cell line (Ramos). Activation of RAMOS cells with PMA and ionomycin increases the expression level of the transcript. The gene encodes a putative nucleoside diphosphate kinase B like protein. These proteins may be involved in inducing transcription and preferentially bind single strand DNA. Thus, the protein encoded by this transcript may play a role in B cell differentiation and/or isotype switching. Thus, expression of this gene or the encoded protein could be used to identify B cells. Furthermore, therapeutics could be designed with the protein encoded by this transcript that might regulate B cell function, and potentially reduce symptoms in diseases where B cells play an important role, including systemic lupus erythematosus and rheumatoid arthritis.

REFERENCES

Agou F, Raveh S, Mesnildrey S, Veron M. Single strand DNA specificity analysis of human nucleoside diphosphate kinase B. J Biol Chem 1999 Jul. 9; 274(28): 19630–8

Nucleoside diphosphate kinases (NDP kinases) form a family of oligomeric enzymes present in all organisms. Eukaryotic NDP kinases are hexamers composed of identical subunits (approximately 17 kDa). A distinctive property of human NDPK-B encoded by the gene nm231-H2 is its ability to stimulate the gene transcription. This property is independent of its catalytic activity and is possibly related to the role of this protein in cellular events including differentiation and tumor metastasis. In this paper, we report the first characterization of human NDPK-B.DNA complex formation using a filter-binding assay and fluorescence spectroscopy. We analyzed the binding of several oligonucleotides mimicking the promoter region of the c-myc oncogene including variants in sequence, structure, and length of both strands. We show that NDPK-B binds to single-stranded oligonucleotides in a nonsequence specific manner, but that it exhibits a poor binding activity to double-stranded oligonucleotides. This indicates that the specificity of recognition to DNA is a function of the structural conformation of DNA rather than of its specific sequence. Moreover, competition experiments performed with all nucleotides provide evidence for the contribution of the six active sites in the DNA.protein complex formation. We propose a mechanism through which human NDPK-B could stimulate transcription of c-myc or possibly other genes involved in cellular differentiation.

PMID: 10391900

NOV23: CG56352-02: T-cell-Immunoglobulin

Expression of gene CG56352-02 was assessed using the primer-probe sets Ag3865, Ag3864 and Ag2918, described in Tables QA, QB and QC. Results of the RTQ-PCR runs are shown in Tables QD, QE, QF and QG.

TABLE QA

Probe Name Ag3865

| Primers | Sequences | Length | Start Position |
|---|---|---|---|
| Forward | 5'-attctgttagacatggcttgca-3' (SEQ ID NO: 425) | 22 | 391 |
| Probe | TET-5'-cctcactcaccgcttgagtcttgg-3'-TAMRA (SEQ ID NO: 426 | 24 | 433 |
| Reverse | 5'-ctgtattccacttctgaggacc-3' (SEQ ID NO: 427) | 22 | 479 |

TABLE QB

Probe Name Ag3864

| Primers | Sequences | Length | Start Position |
|---|---|---|---|
| Forward | 5'-aacctcgtgcccgtctgc-3' (SEQ ID NO: 428) | 18 | 559 |
| Probe | TET-5'-ctgtcctgtgtttgaatgtggcaacgt-3'-TAMRA (SEQ ID NO: 429) | 27 | 591 |
| Reverse | 5'-attcacatcccttcatcag-3' (SEQ ID NO: 430) | 20 | 629 |

TABLE QC

Probe Name Ag2918

| Primers | Sequences | Length | Start Position |
|---|---|---|---|
| Forward | 5'-aaatgcagtagcagagggaatt-3' (SEQ ID NO: 431) | 22 | 1173 |
| Probe | TET-5'-cgctcagaagaaaacatctataccattga-3'-TAMRA (SEQ ID NO: 432) | 29 | 1195 |
| Reverse | 5'-ggctcctccacttcatatacgt-3' (SEQ ID NO: 433) | 22 | 1229 |

TABLE QD

CNS_neurodegeneration_v1.0

| Tissue Name | Rel. Exp. (%) Ag3865, Run 212188106 | Tissue Name | Rel. Exp. (%) Ag3865, Run 212188106 |
|---|---|---|---|
| AD 1 Hippo | 8.8 | Control (Path) 3 Temporal Ctx | 0.0 |
| AD 2 Hippo | 0.0 | Control (Path) 4 Temporal Ctx | 10.7 |
| AD 3 Hippo | 0.0 | AD 1 Occipital Ctx | 6.5 |
| AD 4 Hippo | 0.0 | AD 2 Occipital Ctx (Missing) | 0.0 |
| AD 5 hippo | 12.5 | AD 3 Occipital Ctx | 2.0 |
| AD 6 Hippo | 100.0 | AD 4 Occipital Ctx | 6.6 |
| Control 2 Hippo | 10.1 | AD 5 Occipital Ctx | 21.2 |
| Control 4 Hippo | 1.1 | AD 6 Occipital Ctx | 12.5 |
| Control (Path) 3 Hippo | 0.0 | Control 1 Occipital Ctx | 0.0 |
| AD 1 Temporal Ctx | 9.0 | Control 2 Occipital Ctx | 6.9 |
| AD 2 Temporal Ctx | 10.2 | Control 3 Occipital Ctx | 3.9 |
| AD 3 Temporal Ctx | 0.0 | Control 4 Occipital Ctx | 6.5 |
| AD 4 Temporal Ctx | 4.3 | Control (Path) 1 Occipital Ctx | 16.7 |
| AD 5 Inf Temporal Ctx | 25.5 | Control (Path) 2 Occipital Ctx | 1.7 |
| AD 5 SupTemporal Ctx | 5.4 | Control (Path) 3 Occipital Ctx | 1.6 |
| AD 6 Inf Temporal Ctx | 56.3 | Control (Path) 4 Occipital Ctx | 10.6 |
| AD 6 Sup Temporal Ctx | 85.3 | Control 1 Parietal Ctx | 2.8 |
| Control 1 Temporal Ctx | 0.0 | Control 2 Parietal Ctx | 10.7 |
| Control 2 Temporal Ctx | 9.6 | Control 3 Parietal Ctx | 0.0 |
| Control 3 Temporal Ctx | 0.0 | Control (Path) 1 Parietal Ctx | 15.5 |

TABLE QD-continued

CNS_neurodegeneration_v1.0

| Tissue Name | Rel. Exp. (%) Ag3865, Run 212188106 | Tissue Name | Rel. Exp. (%) Ag3865, Run 212188106 |
|---|---|---|---|
| Control 4 Temporal Ctx | 0.0 | Control (Path) 2 Parietal Ctx | 8.7 |
| Control (Path) 1 Temporal Ctx | 18.0 | Control (Path) 3 Parietal Ctx | 0.0 |
| Control (Path) 2 Temporal Ctx | 17.7 | Control (Path) 4 Parietal Ctx | 4.9 |

TABLE QE

General_screening_panel_v1.4

| Tissue Name | Rel. Exp. (%) Ag3864, Run 217310197 | Rel. Exp. (%) Ag3865, Run 219025099 |
|---|---|---|
| Adipose | 22.7 | 27.5 |
| Melanoma* Hs688(A).T | 0.2 | 2.3 |
| Melanoma* Hs688(B).T | 0.0 | 2.8 |
| Melanoma* M14 | 0.0 | 0.0 |
| Melanoma* LOXIMVI | 0.3 | 0.0 |
| Melanoma* SK-MEL-5 | 0.6 | 0.0 |
| Squamous cell carcinoma SCC-4 | 0.1 | 0.0 |
| Testis Pool | 7.0 | 8.8 |
| Prostate ca.* (bone met) PC-3 | 0.6 | 0.0 |
| Prostate Pool | 4.0 | 6.2 |
| Placenta | 9.0 | 19.9 |
| Uterus Pool | 1.6 | 8.2 |
| Ovarian ca. OVCAR-3 | 0.1 | 8.8 |
| Ovarian ca. SK-OV-3 | 0.7 | 0.0 |
| Ovarian ca. OVCAR-4 | 0.0 | 1.7 |
| Ovarian ca. OVCAR-5 | 1.0 | 11.1 |
| Ovarian ca. IGROV-1 | 0.1 | 2.0 |
| Ovarian ca. OVCAR-8 | 0.0 | 0.0 |
| Ovary | 8.7 | 2.0 |
| Breast ca. MCF-7 | 0.4 | 15.2 |
| Breast ca. MDA-MB-231 | 0.5 | 0.0 |
| Breast ca. BT 549 | 1.0 | 13.2 |
| Breast ca. T47D | 1.6 | 10.5 |
| Breast ca. MDA-N | 0.1 | 0.0 |
| Breast Pool | 13.4 | 10.9 |
| Trachea | 15.5 | 21.3 |
| Lung | 2.4 | 0.0 |
| Fetal Lung | 36.6 | 100.0 |
| Lung ca. NCI-N417 | 0.0 | 1.7 |
| Lung ca. LX-1 | 0.7 | 2.3 |
| Lung ca. NCI-H146 | 0.0 | 0.0 |
| Lung ca. SHP-77 | 0.1 | 1.8 |
| Lung ca. A549 | 0.2 | 1.3 |
| Lung ca. NCI-H526 | 0.0 | 0.0 |
| Lung ca. NCI-H23 | 1.4 | 0.0 |
| Lung ca. NCI-H460 | 0.0 | 0.0 |
| Lung ca. HOP-62 | 0.2 | 2.3 |
| Lung ca. NCI-H522 | 0.2 | 4.7 |
| Liver | 5.7 | 0.0 |
| Fetal Liver | 10.7 | 11.4 |
| Liver ca. HepG2 | 1.4 | 4.8 |
| Kidney Pool | 15.6 | 39.5 |
| Fetal Kidney | 17.3 | 47.0 |
| Renal ca. 786-0 | 5.7 | 10.7 |
| Renal ca. A498 | 0.4 | 2.4 |
| Renal ca. ACHN | 0.1 | 0.0 |
| Renal ca. UO-31 | 0.8 | 0.0 |
| Renal ca. TK-10 | 2.1 | 2.2 |
| Bladder | 87.1 | 61.1 |
| Gastric ca. (liver met.) NCI-N87 | 1.2 | 2.7 |
| Gastric ca. KATO III | 0.2 | 0.0 |
| Colon ca. SW-948 | 0.1 | 0.0 |
| Colon ca. SW480 | 2.0 | 17.9 |
| Colon ca.* (SW480 met) SW620 | 0.1 | 2.3 |
| Colon ca. HT29 | 0.0 | 2.3 |

TABLE QE-continued

General_screening_panel_v1.4

| Tissue Name | Rel. Exp. (%) Ag3864, Run 217310197 | Rel. Exp. (%) Ag3865, Run 219025099 |
|---|---|---|
| Colon ca. HCT-116 | 0.1 | 1.9 |
| Colon ca. CaCo-2 | 3.6 | 44.4 |
| Colon cancer tissue | 68.3 | 42.9 |
| Colon ca. SW1116 | 0.0 | 0.0 |
| Colon ca. Colo-205 | 0.0 | 3.6 |
| Colon ca. SW-48 | 0.0 | 0.0 |
| Colon Pool | 17.1 | 28.9 |
| Small Intestine Pool | 8.0 | 9.5 |
| Stomach Pool | 9.3 | 11.3 |
| Bone Marrow Pool | 5.6 | 9.0 |
| Fetal Heart | 3.9 | 4.9 |
| Heart Pool | 4.6 | 10.3 |
| Lymph Node Pool | 9.6 | 25.2 |
| Fetal Skeletal Muscle | 4.6 | 9.0 |
| Skeletal Muscle Pool | 4.7 | 10.2 |
| Spleen Pool | 100.0 | 41.8 |
| Thymus Pool | 23.8 | 31.0 |
| CNS cancer (glio/astro) U87-MG | 0.6 | 8.7 |
| CNS cancer (gilo/astro) U-118-MG | 0.9 | 4.8 |
| CNS cancer (neuro; met) SK-N-AS | 0.2 | 1.2 |
| CNS cancer (astro) SF-539 | 0.8 | 1.7 |
| CNS cancer (astro) SNB-75 | 3.1 | 19.3 |
| CNS cancer (glio) SNB-19 | 0.1 | 4.3 |
| CNS cancer (glio) SF-295 | 0.7 | 1.7 |
| Brain (Amygdala) Pool | 29.5 | 15.0 |
| Brain (cerebellum) | 18.0 | 9.1 |
| Brain (fetal) | 7.6 | 18.6 |
| Brain (Hippocampus) Pool | 37.6 | 20.7 |
| Cerebral Cortex Pool | 24.0 | 5.8 |
| Brain (Substantia nigra) Pool | 27.7 | 9.5 |
| Brain (Thalamus) Pool | 43.5 | 21.9 |
| Brain (whole) | 21.6 | 6.8 |
| Spinal Cord Pool | 73.7 | 27.9 |
| Adrenal Gland | 25.7 | 37.6 |
| Pituitary gland Pool | 0.8 | 2.1 |
| Salivary Gland | 4.0 | 2.5 |
| Thyroid (female) | 2.7 | 8.3 |
| Pancreatic ca. CAPAN2 | 0.1 | 0.0 |
| Pancreas Pool | 16.2 | 21.0 |

TABLE QF

Panel 2.2

| Tissue Name | Rel. Exp. (%) Ag3864, Run 174448455 |
|---|---|
| Normal Colon | 4.7 |
| Colon cancer (OD06064) | 20.4 |
| Colon Margin (OD06064) | 2.5 |
| Colon cancer (OD06159) | 1.0 |
| Colon Margin (OD06159) | 1.7 |
| Colon cancer (OD06297-04) | 1.3 |
| Colon Margin (OD06297-015) | 4.9 |
| CC Gr.2 ascend colon (ODO3921) | 1.3 |
| CC Margin (ODO3921) | 2.3 |
| Colon cancer metastasis (OD06104) | 7.3 |
| Lung Margin (OD06104) | 20.0 |
| Colon mets to lung (OD04451-01) | 20.6 |
| Lung Margin (OD04451-02) | 21.6 |
| Normal Prostate | 0.5 |
| Prostate Cancer (OD04410) | 0.6 |
| Prostate Margin (OD04410) | 0.8 |
| Normal Ovary | 2.4 |
| Ovarian cancer (OD06283-03) | 12.9 |
| Ovarian Margin (OD06283-07) | 4.7 |
| Ovarian Cancer 064008 | 3.4 |
| Ovarian cancer (OD06145) | 8.3 |
| Ovarian Margin (OD06145) | 2.3 |

TABLE QF-continued

Panel 2.2

| Tissue Name | Rel. Exp. (%) Ag3864, Run 174448455 |
| --- | --- |
| Ovarian cancer (OD06455-03) | 1.1 |
| Ovarian Margin (OD06455-07) | 1.8 |
| Normal Lung | 9.9 |
| Invasive poor diff. lung adeno (OD04945-01) | 10.0 |
| Lung Margin (OD04945-03) | 29.3 |
| Lung Malignant Cancer (OD03126) | 7.1 |
| Lung Margin (OD03126) | 7.4 |
| Lung Cancer (OD05014A) | 13.1 |
| Lung Margin (OD05014B) | 35.4 |
| Lung cancer (OD06081) | 3.6 |
| Lung Margin (OD06081) | 12.9 |
| Lung Cancer (OD04237-01) | 5.9 |
| Lung Margin (OD04237-02) | 32.1 |
| Ocular Melanoma Metastasis | 0.4 |
| Ocular Melanoma Margin (Liver) | 4.1 |
| Melanoma Metastasis | 1.5 |
| Melanoma Margin (Lung) | 11.0 |
| Normal Kidney | 3.7 |
| Kidney Ca, Nuclear grade 2 (OD04338) | 23.0 |
| Kidney Margin (OD04338) | 100.0 |
| Kidney Ca Nuclear grade 1/2 (OD04339) | 24.5 |
| Kidney Margin (OD04339) | 16.0 |
| Kidney Ca, Clear cell type (OD04340) | 4.9 |
| Kidney Margin (OD04340) | 6.8 |
| Kidney Ca, Nuclear grade 3 (OD04348) | 3.4 |
| Kidney Margin (OD04348) | 31.2 |
| Kidney malignant cancer (OD06204B) | 0.7 |
| Kidney normal adjacent tissue (OD06204E) | 18.7 |
| Kidney Cancer (OD04450-01) | 17.0 |
| Kidney Margin (OD04450-03) | 11.1 |
| Kidney Cancer 8120613 | 0.0 |
| Kidney Margin 8120614 | 25.9 |
| Kidney Cancer 9010320 | 9.6 |
| Kidney Margin 9010321 | 18.8 |
| Kidney Cancer 8120607 | 5.3 |
| Kidney Margin 8120608 | 19.9 |
| Normal Uterus | 2.8 |
| Uterine Cancer 064011 | 3.7 |
| Normal Thyroid | 0.2 |
| Thyroid Cancer 064010 | 2.0 |
| Thyroid Cancer A302152 | 5.0 |
| Thyroid Margin A302153 | 1.2 |
| Normal Breast | 4.3 |
| Breast Cancer (OD04566) | 4.0 |
| Breast Cancer 1024 | 3.9 |
| Breast Cancer (OD04590-01) | 10.6 |
| Breast Cancer Mets (OD04590-03) | 14.5 |
| Breast Cancer Metastasis (OD04655-05) | 6.1 |
| Breast Cancer 064006 | 8.2 |
| Breast Cancer 9100266 | 2.4 |
| Breast Margin 9100265 | 2.4 |
| Breast Cancer A209073 | 0.5 |
| Breast Margin A2090734 | 2.2 |
| Breast cancer (OD06083) | 13.8 |
| Breast cancer node metastasis (OD06083) | 16.0 |
| Normal Liver | 3.1 |
| Liver Cancer 1026 | 2.5 |
| Liver Cancer 1025 | 10.6 |
| Liver Cancer 6004-T | 4.5 |
| Liver Tissue 6004-N | 1.2 |
| Liver Cancer 6005-T | 8.1 |
| Liver Tissue 6005-N | 20.7 |
| Liver Cancer 064003 | 2.4 |
| Normal Bladder | 7.3 |
| Bladder Cancer 1023 | 2.5 |
| Bladder Cancer A302173 | 6.0 |
| Normal Stomach | 5.2 |
| Gastric Cancer 9060397 | 4.1 |
| Stomach Margin 9060396 | 5.5 |
| Gastric Cancer 9060395 | 5.6 |
| Stomach Margin 9060394 | 9.6 |
| Gastric Cancer 064005 | 2.6 |

TABLE QG

Panel 4.1D

| Tissue Name | Rel. Exp. (%) Ag3864, Run 172209244 | Rel. Exp. (%) Ag3865, Run 170128795 |
| --- | --- | --- |
| Secondary Th1 | 100.0 | 0.0 |
| Secondary Th2 act | 39.0 | 100.0 |
| Secondary Tr1 act | 36.6 | 0.5 |
| Secondary Th1 rest | 14.0 | 0.1 |
| Secondary Th2 rest | 3.3 | 0.3 |
| Secondary Tr1 rest | 4.9 | 0.1 |
| Primary Th1 act | 8.3 | 0.0 |
| Primary Th2 act | 4.8 | 0.0 |
| Primary Tr1 act | 7.1 | 0.3 |
| Primary Th1 rest | 5.5 | 0.0 |
| Primary Th2 rest | 3.6 | 0.0 |
| Primary Tr1 rest | 2.9 | 0.1 |
| CD45RA CD4 lymphocyte act | 7.6 | 2.1 |
| CD45RO CD4 lymphocyte act | 12.8 | 0.0 |
| CD8 lymphocyte act | 6.5 | 0.2 |
| Secondary CD8 lymphocyte rest | 10.4 | 0.1 |
| Secondary CD8 lymphocyte act | 11.4 | 0.2 |
| CD4 lymphocyte none | 0.5 | 0.0 |
| 2ry Th1/Th2/Tr1_anti-CD95 CH11 | 6.7 | 0.2 |
| LAK cells rest | 17.7 | 0.0 |
| LAK cells IL-2 | 31.0 | 0.0 |
| LAK cells IL-2 + IL-12 | 35.4 | 0.0 |
| LAK cells IL-2 + IFN gamma | 12.6 | 0.0 |
| LAK cells IL-2 + IL-18 | 15.7 | 0.1 |
| LAK cells PMA/ionomycin | 24.1 | 0.0 |
| NK Cells IL-2 rest | 24.7 | 0.0 |
| Two Way MLR 3 day | 11.2 | 0.0 |
| Two Way MLR 5 day | 13.3 | 2.3 |
| Two Way MLR 7 day | 15.8 | 0.9 |
| PBMC rest | 1.7 | 0.0 |
| PBMC PWM | 15.4 | 0.0 |
| PBMC PHA-L | 7.6 | 0.9 |
| Ramos (B cell) none | 0.0 | 0.1 |
| Ramos (B cell) ionomycin | 0.3 | 0.0 |
| B lymphocytes PWM | 5.4 | 0.1 |
| B lymphocytes CD40L and IL-4 | 0.3 | 0.0 |
| EOL-1 dbcAMP | 0.1 | 0.0 |
| EOL-1 dbcAMP PMA/ionomycin | 2.8 | 0.0 |
| Dendritic cells none | 25.0 | 0.0 |
| Dendritic cells LPS | 13.7 | 0.1 |
| Dendritic cells anti-CD40 | 29.5 | 0.0 |
| Monocytes rest | 4.9 | 0.0 |
| Monocytes LPS | 7.2 | 0.2 |
| Macrophages rest | 41.5 | 0.0 |
| Macrophages LPS | 8.8 | 0.0 |
| HUVEC none | 0.0 | 0.0 |
| HUVEC starved | 0.0 | 0.0 |
| HUVEC IL-1 beta | 0.0 | 0.0 |
| HUVEC IFN gamma | 0.1 | 0.0 |
| HUVEC TNF alpha + IFN gamma | 0.0 | 0.0 |
| HUVEC TNF alpha + IL4 | 0.0 | 0.1 |
| HUVEC IL-11 | 0.0 | 3.9 |
| Lung Microvascular EC none | 0.0 | 4.9 |
| Lung Microvascular EC TNF alpha + IL-1 beta | 0.0 | 5.0 |
| Microvascular Dermal EC none | 0.0 | 12.9 |
| Microsvascular Dermal EC TNF alpha + IL-1 beta | 0.0 | 4.5 |
| Bronchial epithelium TNF alpha + IL-1 beta | 0.0 | 5.1 |
| Small airway epithelium none | 0.0 | 6.1 |
| Small airway epithelium TNF alpha + IL-1 beta | 0.0 | 3.3 |
| Coronery artery SMC rest | 0.0 | 0.0 |
| Coronery artery SMC TNF alpha + IL-1 beta | 0.0 | 0.1 |
| Astrocytes rest | 0.0 | 4.5 |
| Astrocytes TNF alpha + IL-1 beta | 0.0 | 0.0 |
| KU-812 (Basophil) rest | 0.1 | 0.0 |
| KU-812 (Basophil) PMA/ionomycin | 0.7 | 2.6 |
| CCD1106 (Keratinocytes) none | 0.0 | 14.2 |
| CCD1106 (Keratinocytes) TNF alpha + IL-1 beta | 0.0 | 2.3 |

TABLE QG-continued

Panel 4.1D

| Tissue Name | Rel. Exp. (%) Ag3864, Run 172209244 | Rel. Exp. (%) Ag3865, Run 170128795 |
|---|---|---|
| Liver cirrhosis | 1.3 | 8.1 |
| NCI-H292 none | 0.0 | 3.5 |
| NCI-H292 IL-4 | 0.0 | 6.0 |
| NCI-H292 IL-9 | 0.0 | 6.4 |
| NCI-H292 IL-13 | 0.0 | 20.4 |
| NCI-H292 IFN gamma | 0.0 | 9.0 |
| HPAEC none | 0.0 | 32.1 |
| HPAEC TNF alpha + IL-1 beta | 0.0 | 7.6 |
| Lung fibroblast none | 0.1 | 3.0 |
| Lung fibroblast TNF alpha + IL-1 beta | 0.4 | 0.7 |
| Lung fibroblast IL-4 | 0.1 | 0.3 |
| Lung fibroblast IL-9 | 0.3 | 7.4 |
| Lung fibroblast IL-13 | 0.1 | 4.2 |
| Lung fibroblast IFN gamma | 0.5 | 2.5 |
| Dermal fibroblast CCD1070 rest | 0.6 | 3.7 |
| Dermal fibroblast CCD1070 TNF alpha | 16.0 | 2.1 |
| Dermal fibroblast CCD1070 IL-1 beta | 0.0 | 1.1 |
| Dermal fibroblast IFN gamma | 0.0 | 1.8 |
| Dermal fibroblast IL-4 | 0.0 | 2.4 |
| Dermal Fibroblasts rest | 0.0 | 4.8 |
| Neutrophils TNFa + LPS | 0.3 | 1.1 |
| Neutrophils rest | 0.0 | 2.1 |
| Colon | 0.3 | 1.4 |
| Lung | 3.5 | 0.6 |
| Thymus | 1.6 | 2.5 |
| Kidney | 2.8 | 17.3 |

CNS_neurodegeneration_v1.0 Summary: Ag3865 This panel confirms the expression of the CG56352-02 gene in the CNS. See General_screening_panel_v1.4 for a discussion of utility. Ag2918 Expression of the CG56352-02 gene is low/undetectable in all samples on this panel (CTs>35).

General_screening_panel_v1.4 Summary: Ag3864/Ag3865 Two experiments produce results that are in very good agreement, with highest expression of the CG56352-02 gene in fetal lung and spleen (CT=28–32). Furthermore, expression of this gene is higher in fetal lung (CTs=28–30) when compared to expression in the adult (CTs=33–40). Thus, expression of this gene could be used to differentiate between fetal and adult lung tissue.

Low, but significant expression of this gene is also seen in colon, breast, renal and CNS cancer cell lines on this panel. Thus, expression of this gene may be associated with these cancers and modulation of expression might be used for treatment of colon, breast, renal and brain cancers.

Among tissues with metabolic function, this gene is expressed at low levels in adipose, adult and fetal liver, adult and fetal heart, adult and fetal skeletal muscle, adrenal, thyroid and pancreas. Based on its tissue distribution, this gene product may be important for the pathogenesis, diagnosis, and/or treatment of endocrine and metabolic disease, including obesity and Types 1 and 2 diabetes.

This gene is expressed at moderate levels in the CNS. Therapeutic modulation of this gene or its protein product may be of use in controlling the inflammatory response and be of benefit in any clinical condition associated with neuroinflammation, such as stroke, head or spinal cord trauma, multiple sclerosis, Alzheimer's disease, and viral infections of the CNS.

Panel 1.3D Summary: Ag2918 Expression of the CG56352-02 gene is low/undetectable in all samples on this panel (CTs>35).

Panel 2.2 Summary: Ag3864 The CG56352-02 gene is expressed at low level in the tissues used for panel 2.2. The highest expression is seen in a normal kidney sample (CT=29.7). In addition, there appears to be increased expression in 5 of 6 samples of normal lung tissue when compared to lung cancers and in 7 of 9 samples of normal kidney compared to the adjacent kidney cancer tissue. Thus, loss of expression of this gene may be associated with these cancers and therapeutic modulation of this gene may therefore be of use in the treatment of these cancers.

Panel 2D Summary: Ag2918 Expression of the CG56352-02 gene is low/undetectable in all samples on this panel (CTs>35).

Panel 4.1D Summary: Ag 3864 The CG56352-02 transcript is found in T cells, particularly chronically activated Th1, Th2 and Tr1 cells. LAK cells, macrophages and dendritic cells also express the transcript. The only non-hematopoietic cell type that expresses the transcript detected by these primers and probe are dermal fibroblasts. Lung, thymus and kidney also express low levels of the transcript. Thus, this transcript or the protein it encodes could be used to detect hematopoietically-derived cells. Furthermore, therapeutics designed with the protein encoded by this transcript could be important in the regulation the function of antigen presenting cells (macrophages and dendritic cells) or T cells and be important in the treatment of asthma, emphysema, psoriasis, arthrtis, and IBD.

Ag3865 The CG56352-02 transcript is expressed at low levels in many tissues and at high levels in Th2 cells. The expression profile in this panel using this probe and primer set differs from the Ag3864 results in the expression seen in many nonhematopoitic tissues. Therapeutics designed with the protein encoded by this transcript could be important in the regulation of T cell function.

Panel 4D Summary: Ag2918 Expression of the CG56352-02 gene is low/undetectable in all samples on this panel (CTs>35).

NOV24a and NOV24b: CG56062-01 and CG56062-02: Organic Anion Transporter 3

Expression of gene CG56062-01 and variant CG56062-02 was assessed using the primer-probe sets Ag3948, Ag2874 and Ag3532, described in Tables RA, RB and RC. Results of the RTQ-PCR runs are shown in Tables RD, RE, RF, RG, RH, RI and RJ.

TABLE RA

Probe Name Ag3948

| Primers | Sequences | Length | Start Position |
|---|---|---|---|
| Forward | 5'-ctctattcttggtggcttcca-3' (SEQ ID NO:434) | 21 | 851 |
| Probe | TET-5'-ctcctgcatggcaagtcccagttag-3'-TAMRA (SEQ ID NO:435) | 25 | 890 |
| Reverse | 5'-ccaccttctgcagattctgtac-3' (SEQ ID NO:436) | 22 | 917 |

TABLE RB

Probe Name Ag2874

| Primers | Sequences | Length | Start Position |
|---|---|---|---|
| Forward | 5'-ccaactcaatcttggacctctt-3' (SEQ ID NO:437) | 22 | 1032 |

TABLE RB-continued

Probe Name Ag2874

| Primers | Sequences | Length | Start Position |
|---|---|---|---|
| Probe | TET-5'-atccgcaaggtcacatgctgtctcat-3'-TAMRA (SEQ ID NO:438) | 26 | 1067 |
| Reverse | 5'-cagagttggagaaccaaatcac-3' (SEQ ID NO:439) | 22 | 1094 |

TABLE RC

Probe Name Ag3532

| Primers | Sequences | Length | Start Position |
|---|---|---|---|
| Forward | 5'-ccaactcaatcttggacctctt-3' (SEQ ID NO:440) | 22 | 1032 |
| Probe | TET-5'-atccgcaaggtcacatgctgtctcat-3'-TAMRA (SEQ ID NO:441) | 26 | 1067 |
| Reverse | 5'-cagagttggagaaccaaatcac-3' (SEQ ID NO:442) | 22 | 1094 |

TABLE RD

CNS_neurodegeneration_v1.0

| Tissue Name | Rel. Exp. (%) Ag3948, Run 212345604 |
|---|---|
| AD 1 Hippo | 0.0 |
| AD 2 Hippo | 57.0 |
| AD 3 Hippo | 32.5 |
| AD 4 Hippo | 0.0 |
| AD 5 Hippo | 47.0 |
| AD 6 Hippo | 20.3 |
| Control 2 Hippo | 0.0 |
| Control 4 Hippo | 0.0 |
| Control (Path) 3 Hippo | 0.0 |
| AD 1 Temporal Ctx | 0.0 |
| AD 2 Temporal Ctx | 16.7 |
| AD 3 Temporal Ctx | 14.9 |
| AD 4 Temporal Ctx | 0.0 |
| AD 5 Inf Temporal Ctx | 100.0 |
| AD 5 Sup Temporal Ctx | 0.0 |
| AD 6 Inf Temporal Ctx | 65.1 |
| AD 6 Sup Temporal Ctx | 91.4 |
| Control 1 Temporal Ctx | 0.0 |
| Control 2 Temporal Ctx | 0.0 |
| Control 3 Temporal Ctx | 0.0 |
| Control 3 Temporal Ctx | 18.0 |
| Control (Path) 1 Temporal Ctx | 32.1 |
| Control (Path) 2 Temporal Ctx | 9.7 |
| Control (Path) 3 Temporal Ctx | 0.0 |
| Control (Path) 4 Temporal Ctx | 33.4 |
| AD 1 Occipital Ctx | 67.8 |
| AD 2 Occipital Ctx (Missing) | 5.3 |
| AD 3 Occipital Ctx | 0.0 |
| AD 4 Occipital Ctx | 0.0 |
| AD 5 Occipital Ctx | 18.4 |
| AD 6 Occipital Ctx | 39.2 |
| Control 1 Occipital Ctx | 0.0 |
| Control 2 Occipital Ctx | 79.6 |
| Control 3 Occipital Ctx | 42.0 |
| Control 4 Occipital Ctx | 0.0 |
| Control (Path) 1 Occipital Ctx | 46.0 |
| Control (Path) 2 Occipital Ctx | 0.0 |
| Control (Path) 3 Occipital Ctx | 0.0 |
| Control (Path) 4 Occipital Ctx | 11.7 |
| Control 1 Parietal Ctx | 10.3 |
| Control 2 Parietal Ctx | 49.3 |
| Control 3 Parietal Ctx | 0.0 |
| Control (Path) 1 Parietal Ctx | 67.8 |

TABLE RD-continued

CNS_neurodegeneration_v1.0

| Tissue Name | Rel. Exp. (%) Ag3948, Run 212345604 |
|---|---|
| Control (Path) 2 Parietal Ctx | 14.4 |
| Control (Path) 3 Parietal Ctx | 0.0 |
| Control (Path) 4 Parietal Ctx | 20.4 |

TABLE RE

General_screening_panel_v1.4

| Tissue Name | Rel. Exp. (%) Ag3948, Run 219279808 |
|---|---|
| Adipose | 0.3 |
| Melanoma* Hs688(A).T | 0.5 |
| Melanoma* Hs688(B).T | 0.2 |
| Melanoma* M14 | 0.2 |
| Melanoma* LOXIMVI | 0.0 |
| Melanoma* SK-MEL-5 | 0.1 |
| Squamous cell carcinoma SCC-4 | 2.4 |
| Testis Pool | 0.3 |
| Prostate ca.* (bone met) PC-3 | 0.9 |
| Prostate Pool | 0.3 |
| Placenta | 0.2 |
| Uterus Pool | 0.1 |
| Ovarian ca. OVCAR-3 | 11.5 |
| Ovarian ca. SK-OV-3 | 1.3 |
| Ovarian ca. OVCAR-4 | 0.4 |
| Ovarian ca. OVCAR-5 | 8.0 |
| Ovarian ca. IGROV-1 | 1.9 |
| Ovarian ca. OVCAR-8 | 0.5 |
| Ovary | 0.4 |
| Breast ca. MCF-7 | 3.2 |
| Breast ca. MDA-MB-231 | 2.3 |
| Breast ca. BT 549 | 0.2 |
| Breast ca. T47D | 9.6 |
| Breast ca. MDA-N | 0.2 |
| Breast Pool | 0.7 |
| Trachea | 0.6 |
| Lung | 0.2 |
| Fetal Lung | 1.7 |
| Lung ca. NCI-N417 | 0.1 |
| Lung ca. LX-1 | 100.0 |
| Lung ca. NCI-H146 | 1.0 |
| Lung ca. SHP-77 | 0.1 |
| Lung ca. A549 | 2.2 |
| Lung ca. NCI-H526 | 0.1 |
| Lung ca. NCI-H23 | 0.9 |
| Lung ca. NCI-H460 | 0.2 |
| Lung ca. HOP-62 | 0.5 |
| Lung ca. NCI-H522 | 1.1 |
| Liver | 0.3 |
| Fetal Liver | 0.8 |
| Liver ca. HepG2 | 0.2 |
| Kidney Pool | 0.7 |
| Fetal Kidney | 0.7 |
| Renal ca. 786-0 | 0.2 |
| Renal ca. A498 | 0.2 |
| Renal ca. ACHN | 0.2 |
| Renal ca. UO-31 | 1.6 |
| Renal ca. TK-10 | 2.1 |
| Bladder | 2.8 |
| Gastric ca. (liver met.) NCI-N87 | 22.2 |
| Gastric ca. KATO III | 4.0 |
| Colon ca. SW-948 | 0.1 |
| Colon ca. SW480 | 10.5 |
| Colon ca.* (SW480 met) SW620 | 1.6 |
| Colon ca. HT29 | 1.5 |
| Colon ca. HCT-116 | 2.3 |
| Colon ca. CaCo-2 | 0.7 |
| Colon cancer tissue | 0.2 |
| Colon ca. SW1116 | 0.1 |
| Colon ca. Colo-205 | 0.6 |

TABLE RE-continued

General_screening_panel_v1.4

| Tissue Name | Rel. Exp. (%) Ag3948, Run 219279808 |
|---|---|
| Colon ca. SW-48 | 0.8 |
| Colon Pool | 0.6 |
| Small Intestine Pool | 0.4 |
| Stomach Pool | 0.1 |
| Bone Marrow Pool | 0.4 |
| Fetal Heart | 0.1 |
| Heart Pool | 0.3 |
| Lymph Node Pool | 0.7 |
| Fetal Skeletal Muscle | 0.6 |
| Skeletal Muscle Pool | 0.4 |
| Spleen Pool | 0.2 |
| Thymus Pool | 0.3 |
| CNS cancer (glio/astro) U87-MG | 0.5 |
| CNS cancer (glio/astro) U-118-MG | 0.1 |
| CNS cancer (neuro; met) SK-N-AS | 0.4 |
| CNS cancer (astro) SF-539 | 0.1 |
| CNS cancer (astro) SNB-75 | 0.1 |
| CNS cancer (glio) SNB-19 | 0.9 |
| CNS cancer (glio) SF-295 | 9.3 |
| Brain (Amygdala) Pool | 0.1 |
| Brain (cerebellum) | 5.1 |
| Brain (fetal) | 2.3 |
| Brain (Hippocampus) Pool | 0.0 |
| Cerebral Cortex Pool | 0.0 |
| Brain (*Substantia nigra*) Pool | 0.2 |
| Brain (Thalamus) Pool | 0.0 |
| Brain (whole) | 0.8 |
| Spinal Cord Pool | 0.0 |
| Adrenal Gland | 0.2 |
| Pituitary gland Pool | 0.0 |
| Salivary Gland | 0.1 |
| Thyroid (female) | 0.7 |
| Pancreatic ca. CAPAN2 | 3.8 |
| Pancreas Pool | 0.6 |

TABLE RF

Panel 1.3D

| Tissue Name | Rel. Exp. (%) Ag2874, Run 161973724 | Rel. Exp. (%) Ag2874, Run 165721687 |
|---|---|---|
| Liver adenocarcinoma | 4.9 | 5.6 |
| Pancreas | 0.0 | 0.0 |
| Pancreatic ca. CAPAN 2 | 0.0 | 0.0 |
| Adrenal gland | 0.0 | 0.0 |
| Thyroid | 0.0 | 6.3 |
| Salivary gland | 0.0 | 0.0 |
| Pituitary gland | 0.0 | 0.0 |
| Brain (fetal) | 0.0 | 3.8 |
| Brain (whole) | 3.1 | 6.1 |
| Brain (amygdala) | 4.3 | 0.0 |
| Brain (cerebellum) | 1.8 | 7.6 |
| Brain (hippocampus) | 0.0 | 0.0 |
| Brain (*substantia nigra*) | 0.0 | 3.5 |
| Brain (thalamus) | 0.0 | 0.0 |
| Cerebral Cortex | 2.3 | 0.0 |
| Spinal cord | 0.0 | 0.0 |
| glio/astro U87-MG | 0.0 | 0.0 |
| glio/astro U-118-MG | 0.0 | 0.0 |
| astrocytoma SW1783 | 0.0 | 0.0 |
| neuro*; met SK-N-AS | 0.0 | 0.0 |
| astrocytoma SF-539 | 3.8 | 0.0 |
| astrocytoma SNB-75 | 0.0 | 0.0 |
| glioma SNB-19 | 0.0 | 0.0 |
| glioma U251 | 0.0 | 0.0 |
| glioma SF-295 | 10.7 | 12.5 |
| Heart (fetal) | 0.0 | 0.0 |
| Heart | 0.0 | 0.0 |
| Skeletal muscle (fetal) | 0.0 | 5.3 |
| Skeletal muscle | 0.0 | 0.0 |
| Bone marrow | 17.9 | 6.1 |
| Thymus | 18.7 | 0.0 |
| Spleen | 0.0 | 0.0 |
| Lymph node | 10.5 | 0.0 |
| Colorectal | 4.9 | 3.1 |
| Stomach | 0.0 | 0.0 |
| Small intestine | 0.0 | 0.0 |
| Colon ca. SW480 | 2.7 | 0.0 |
| Colon ca.* SW620 (SW480 met) | 0.0 | 0.0 |
| Colon ca. HT29 | 0.0 | 0.0 |
| Colon ca. HCT-116 | 0.0 | 0.0 |
| Colon ca. CaCo-2 | 0.0 | 0.0 |
| Colon ca. tissue (ODO3866) | 8.8 | 0.0 |
| Colon ca. HCC-2998 | 17.1 | 2.7 |
| Gastric ca.* (liver met) NCI-N87 | 28.9 | 13.4 |
| Bladder | 13.6 | 0.0 |
| Trachea | 6.7 | 5.6 |
| Kidney | 2.6 | 0.0 |
| Kidney (fetal) | 0.0 | 0.0 |
| Renal ca. 786-0 | 0.0 | 0.0 |
| Renal ca. A498 | 0.0 | 0.0 |
| Renal ca. RXF 393 | 0.0 | 0.0 |
| Renal ca. ACHN | 0.0 | 0.0 |
| Renal ca. UO-31 | 0.0 | 0.0 |
| Renal ca. TK-10 | 0.0 | 0.0 |
| Liver | 0.0 | 3.1 |
| Liver (fetal) | 0.0 | 0.0 |
| Liver ca. (hepatoblast) HepG2 | 0.0 | 0.0 |
| Lung | 0.0 | 0.0 |
| Lung (fetal) | 4.5 | 4.1 |
| Lung ca. (small cell) LX-1 | 100.0 | 100.0 |
| Lung ca. (small cell) NCI-H69 | 0.0 | 3.2 |
| Lung ca. (s. cell var.) SHP-77 | 0.0 | 0.0 |
| Lung ca. (large cell) NCI-H460 | 0.0 | 0.0 |
| Lung ca. (non-sm. cell) A549 | 0.0 | 0.0 |
| Lung ca. (non-s. cell) NCI-H23 | 0.0 | 0.0 |
| Lung ca. (non-s. cell) HOP-62 | 0.0 | 0.0 |
| Lung ca. (non-s. cell) NCI-H522 | 1.7 | 0.0 |
| Lung ca. (squam.) SW 900 | 2.1 | 0.0 |
| Lung ca. (squam.) NCI-H596 | 0.0 | 0.0 |
| Mammary gland | 0.0 | 0.0 |
| Breast ca.* (pl. ef) MCF-7 | 13.9 | 0.0 |
| Breast ca.* (pl. ef) MDA-MB-231 | 2.6 | 0.0 |
| Breast ca.* (pl. ef) T47D | 3.2 | 4.7 |
| Breast ca. BT-549 | 0.0 | 0.0 |
| Breast ca. MDA-N | 0.0 | 0.0 |
| Ovary | 0.0 | 0.0 |
| Ovarian ca. OVCAR-3 | 24.1 | 4.7 |
| Ovarian ca. OVCAR-4 | 4.7 | 0.0 |
| Ovarian ca. OVCAR-5 | 4.8 | 4.8 |
| Ovarian ca. OVCAR-8 | 0.0 | 0.0 |
| Ovarian ca. IGROV-1 | 3.0 | 0.0 |
| Ovarian ca.* (ascites) SK-OV-3 | 0.0 | 3.4 |
| Uterus | 0.0 | 6.5 |
| Placenta | 0.0 | 0.0 |
| Prostate | 10.8 | 2.7 |
| Prostate ca.* (bone met) PC-3 | 0.0 | 0.0 |
| Testis | 0.0 | 0.0 |
| Melanoma Hs688(A).T | 0.0 | 0.0 |
| Melanoma* (met) Hs688(B).T | 0.0 | 0.0 |
| Melanoma UACC-62 | 0.0 | 0.0 |
| Melanoma M14 | 0.0 | 0.0 |
| Melanoma LOX IMVI | 0.0 | 0.0 |
| Melanoma* (met) SK-MEL-5 | 0.0 | 0.0 |
| Adipose | 0.0 | 0.0 |

TABLE RG

Panel 2D

| Tissue Name | Rel. Exp. (%) Ag2874, Run 161973958 |
|---|---|
| Normal Colon | 24.3 |
| CC Well to Mod Diff (ODO3866) | 0.0 |
| CC Margin (ODO3866) | 26.2 |
| CC Gr.2 rectosigmoid (ODO3868) | 0.0 |
| CC Margin (ODO3868) | 13.8 |
| CC Mod Diff (ODO3920) | 11.7 |
| CC Margin (ODO3920) | 0.0 |
| CC Gr.2 ascend colon (ODO3921) | 65.1 |
| CC Margin (ODO3921) | 0.0 |
| CC from Partial Hepatectomy (ODO4309) Mets | 27.9 |
| Liver Margin (ODO4309) | 0.0 |
| Colon mets to lung (OD04451-01) | 7.5 |
| Lung Margin (OD04451-02) | 0.0 |
| Normal Prostate 6546-1 | 13.0 |
| Prostate Cancer (OD04410) | 0.0 |
| Prostate Margin (OD04410) | 0.0 |
| Prostate Cancer (OD04720-01) | 59.5 |
| Prostate Margin (OD04720-02) | 28.7 |
| Normal Lung O61010 | 0.0 |
| Lung Met to Muscle (ODO4286) | 0.0 |
| Muscle Margin (ODO4286) | 0.0 |
| Lung Malignant Cancer (OD03126) | 0.0 |
| Lung Margin (OD03126) | 11.3 |
| Lung Cancer (OD04404) | 0.0 |
| Lung Margin (OD04404) | 0.0 |
| Lung Cancer (OD04565) | 16.3 |
| Lung Margin (OD04565) | 0.0 |
| Lung Cancer (OD04237-01) | 0.0 |
| Lung Margin (OD04237-02) | 0.0 |
| Ocular Mel Met to Liver (ODO4310) | 0.0 |
| Liver Margin (ODO4310) | 0.0 |
| Melanoma Mets to Lung (OD04321) | 0.0 |
| Lung Margin (OD04321) | 0.0 |
| Normal Kidney | 16.5 |
| Kidney Ca, Nuclear grade 2 (OD04338) | 16.0 |
| Kidney Margin (OD04338) | 14.1 |
| Kidney Ca Nuclear grade 1/2 (OD04339) | 13.9 |
| Kidney Margin (OD04339) | 13.0 |
| Kidney Ca, Clear cell type (OD04340) | 0.0 |
| Kidney Margin (OD04340) | 0.0 |
| Kidney Ca, Nuclear grade 3 (OD04348) | 14.8 |
| Kidney Margin (OD04348) | 0.0 |
| Kidney Cancer (OD04622-01) | 0.0 |
| Kidney Margin (OD04622-03) | 0.0 |
| Kidney Cancer (OD04450-01) | 0.0 |
| Kidney Margin (OD04450-03) | 19.2 |
| Kidney Cancer 8120607 | 23.5 |
| Kidney Margin 8120608 | 0.0 |
| Kidney Cancer 8120613 | 0.0 |
| Kidney Margin 8120614 | 21.3 |
| Kidney Cancer 9010320 | 0.0 |
| Kidney Margin 9010321 | 0.0 |
| Normal Uterus | 0.0 |
| Uterus Cancer 064011 | 10.8 |
| Normal Thyroid | 20.2 |
| Thyroid Cancer 064010 | 42.6 |
| Thyroid Cancer A302152 | 24.1 |
| Thyroid Margin A302153 | 0.0 |
| Normal Breast | 0.0 |
| Breast Cancer (OD04566) | 0.0 |
| Breast Cancer (OD04590-01) | 49.7 |
| Breast Cancer Mets (OD04590-03) | 18.8 |
| Breast Cancer Metastasis (OD04655-05) | 58.2 |
| Breast Cancer 064006 | 40.9 |
| Breast Cancer 1024 | 100.0 |
| Breast Cancer 9100266 | 9.7 |
| Breast Margin 9100265 | 43.5 |
| Breast Cancer A209073 | 32.5 |
| Breast Margin A2090734 | 13.4 |
| Normal Liver | 0.0 |
| Liver Cancer 064003 | 0.0 |
| Liver Cancer 1025 | 0.0 |
| Liver Cancer 1026 | 0.0 |
| Liver Cancer 6004-T | 0.0 |
| Liver Tissue 6004-N | 0.0 |
| Liver Cancer 6005-T | 0.0 |
| Liver Tissue 6005-N | 0.0 |
| Normal Bladder | 58.2 |
| Bladder Cancer 1023 | 0.0 |
| Bladder Cancer A302173 | 16.6 |
| Bladder Cancer (OD04718-01) | 66.0 |
| Bladder Normal Adjacent (OD04718-03) | 0.0 |
| Normal Ovary | 0.0 |
| Ovarian Cancer 064008 | 85.9 |
| Ovarian Cancer (OD04768-07) | 0.0 |
| Ovary Margin (OD04768-08) | 0.0 |
| Normal Stomach | 14.7 |
| Gastric Cancer 9060358 | 0.0 |
| Stomach Margin 9060359 | 0.0 |
| Gastric Cancer 9060395 | 0.0 |
| Stomach Margin 9060394 | 14.0 |
| Gastric Cancer 9060397 | 17.2 |
| Stomach Margin 9060396 | 0.0 |
| Gastric Cancer 064005 | 20.3 |

TABLE RH

Panel 3D

| Tissue Name | Rel. Exp. (%) Ag2874, Run 164543575 |
|---|---|
| Daoy- Medulloblastoma | 0.0 |
| TE671- Medulloblastoma | 0.0 |
| D283 Med- Medulloblastoma | 0.0 |
| PFSK-1- Primitive Neuroectodermal | 0.0 |
| XF-498- CNS | 0.0 |
| SNB-78- Glioma | 0.0 |
| SF-268- Glioblastoma | 0.0 |
| T98G- Glioblastoma | 0.0 |
| SK-N-SH- Neuroblastoma (metastasis) | 0.0 |
| SF-295- Glioblastoma | 0.0 |
| Cerebellum | 0.5 |
| Cerebellum | 2.3 |
| NCI-H292- Mucoepidermoid lung carcinoma | 16.8 |
| DMS-114- Small cell lung cancer | 0.0 |
| DMS-79- Small cell lung cancer | 4.2 |
| NCI-H146- Small cell lung cancer | 0.0 |
| NCI-H526- Small cell lung cancer | 0.0 |
| NCI-N417- Small cell lung cancer | 0.0 |
| NCI-H82- Small cell lung cancer | 0.0 |
| NCI-H157- Squamous cell lung cancer (metastasis) | 0.0 |
| NCI-H1155- Large cell lung cancer | 0.0 |
| NCI-H1299- Large cell lung cancer | 16.6 |
| NCI-H727- Lung carcinoid | 0.0 |
| NCI-UMC-11- Lung carcinoid | 0.0 |
| LX-1- Small cell lung cancer | 48.0 |
| Colo-205- Colon cancer | 9.9 |
| KM12- Colon cancer | 0.0 |
| KM20L2- Colon cancer | 0.0 |
| NCI-H716- Colon cancer | 0.0 |
| SW-48- Colon adenocarcinoma | 0.0 |
| SW1116- Colon adenocarcinoma | 0.0 |
| LS 174T- Colon adenocarcinoma | 8.3 |
| SW-948- Colon adenocarcinoma | 5.1 |
| SW-480- Colon adenocarcinoma | 0.0 |
| NCI-SNU-5- Gastric carcinoma | 13.5 |
| KATO III- Gastric carcinoma | 0.0 |
| NCI-SNU-16- Gastric carcinoma | 0.0 |
| NCI-SNU-1- Gastric carcinoma | 0.0 |
| RF-1- Gastric adenocarcinoma | 0.0 |
| RF-48- Gastric adenocarcinoma | 0.0 |
| MKN-45- Gastric carcinoma | 0.0 |
| NCI-N87- Gastric carcinoma | 0.0 |

TABLE RH-continued

Panel 3D

| Tissue Name | Rel. Exp. (%) Ag2874, Run 164543575 |
|---|---|
| OVCAR-5- Ovarian carcinoma | 10.2 |
| RL95-2- Uterine carcinoma | 0.0 |
| HelaS3- Cervical adenocarcinoma | 0.0 |
| Ca Ski- Cervical epidermoid carcinoma (metastasis) | 0.0 |
| ES-2- Ovarian clear cell carcinoma | 0.0 |
| Ramos- Stimulated with PMA/ionomycin 6h | 0.0 |
| Ramos- Stimulated with PMA/ionomycin 14h | 0.0 |
| MEG-01- Chronic myelogenous leukemia (megokaryoblast) | 0.0 |
| Raji- Burkitt's lymphoma | 3.3 |
| Daudi- Burkitt's lymphoma | 0.0 |
| U266- B-cell plasmacytoma | 0.0 |
| CA46- Burkitt's lymphoma | 0.0 |
| RL- non-Hodgkin's B-cell lymphoma | 0.0 |
| JM1- pre-B-cell lymphoma | 0.0 |
| Jurkat- T cell leukemia | 0.0 |
| TF-1- Erythroleukemia | 0.0 |
| HUT 78- T-cell lymphoma | 8.2 |
| U937- Histiocytic lymphoma | 0.0 |
| KU-812- Myelogenous leukemia | 0.0 |
| 769-P- Clear cell renal carcinoma | 0.0 |
| Caki-2- Clear cell renal carcinoma | 0.0 |
| SW 839- Clear cell renal carcinoma | 2.9 |
| G401- Wilms' tumor | 0.0 |
| Hs766T- Pancreatic carcinoma (LN metastasis) | 3.6 |
| CAPAN-1- Pancreatic adenocarcinoma (liver metastasis) | 4.4 |
| SU86.86- Pancreatic carcinoma (liver metastasis) | 100.0 |
| BxPC-3- Pancreatic adenocarcinoma | 0.0 |
| HPAC- Pancreatic adenocarcinoma | 3.6 |
| MIA PaCa-2- Pancreatic carcinoma | 0.0 |
| CFPAC-1- Pancreatic ductal adenocarcinoma | 4.4 |
| PANC-1- Pancreatic epithelioid ductal carcinoma | 0.0 |
| T24- Bladder carcinoma (transitional cell) | 3.9 |
| 5637- Bladder carcinoma | 0.0 |
| HT-1197- Bladder carcinoma | 0.0 |
| UM-UC-3- Bladder carcinoma (transitional cell) | 0.0 |
| A204- Rhabdomyosarcoma | 0.0 |
| HT-1080- Fibrosarcoma | 0.0 |
| MG-63- Osteosarcoma | 0.0 |
| SK-LMS-1 - Leiomyosarcoma (vulva) | 4.1 |
| SJRH30- Rhabdomyosarcoma (met to bone marrow) | 0.0 |
| A431- Epidermoid carcinoma | 0.0 |
| WM266-4- Melanoma | 0.0 |
| DU 145- Prostate carcinoma (brain metastasis) | 0.0 |
| MDA-MB-468- Breast adenocarcinoma | 6.5 |
| SCC-4- Squamous cell carcinoma of tongue | 0.0 |
| SCC-9- Squamous cell carcinoma of tongue | 0.0 |
| SCC-15- Squamous cell carcinoma of tongue | 0.0 |
| CAL 27- Squamous cell carcinoma of tongue | 21.6 |

TABLE RI

Panel 4.1D

| Tissue Name | Rel. Exp. (%) Ag3948, Run 170684837 | Tissue Name | Rel. Exp. (%) Ag3948, Run 170684837 |
|---|---|---|---|
| Secondary Th1 act | 1.6 | HUVEC IL-1 beta | 3.1 |
| Secondary Th2 act | 8.6 | HUVEC IFN gamma | 7.4 |
| Secondary Tr1 act | 4.4 | HUVEC TNF alpha + IFN gamma | 2.7 |
| Secondary Th1 rest | 0.3 | HUVEC TNF alpha + IL4 | 0.9 |
| Secondary Th2 rest | 3.9 | HUVEC IL-11 | 6.0 |
| Secondary Tr1 rest | 1.6 | Lung Microvascular EC none | 7.3 |
| Primary Th1 act | 0.3 | Lung Microvascular EC TNF alpha + IL-1 beta | 2.7 |
| Primary Th2 act | 1.6 | Microvascular Dermal EC none | 0.0 |
| Primary Tr1 act | 0.0 | Microvasular Dermal EC TNF alpha + IL-1 beta | 0.5 |
| Primary Th1 rest | 0.0 | Bronchial epthelium TNF alpha + IL1 beta | 15.5 |
| Primary Th2 rest | 1.6 | Small airway epithelium none | 6.3 |
| Primary Tr1 rest | 0.4 | Small airway epithelium TNF alpha + IL-1 beta | 20.4 |
| CD45RA CD4 lymphocyte act | 0.0 | Coronery artery SMC rest | 6.0 |
| CD45RO CD4 lymphocyte act | 1.2 | Coronery artery SMC TNF alpha IL-1 beta | 1.6 |
| CD8 lymphocyte act | 2.8 | Astrocytes rest | 0.3 |
| Secondary CD8 lymphocyte rest | 2.0 | Astrocytes TNF alpha + IL-1 beta | 1.5 |
| Secondary CD8 lymphocyte act | 1.2 | KU-812 (Basophil) rest | 3.4 |
| CD4 lymphocyte none | 1.6 | KU-812 (Basophil) PMA/ionomycin | 6.3 |
| 2ry Th1/Th2/Tr1_anti-CD95 CH11 | 4.6 | CCD1106 (Keratinocytes) none | 14.6 |
| LAK cells rest | 1.6 | CCD1106 (Keratinocytes) TNF alpha + IL-1 beta | 20.6 |
| LAK cells IL-2 | 1.7 | Liver cirrhosis | 0.0 |
| LAK cells IL-2 + IL-12 | 3.6 | NCI-H292 none | 49.7 |
| LAK cells IL-2 + IFN gamma | 0.0 | NCI-H292 IL-4 | 79.6 |
| LAK cells IL-2 + IL-18 | 1.7 | NCI-H292 IL-9 | 92.7 |
| LAK cells PMA/ionomycin | 0.0 | NCI-H292 IL-13 | 58.2 |
| NK Cells IL-2 rest | 4.9 | NCI-H292 IFN gamma | 50.0 |
| Two Way MLR 3 day | 3.1 | HPAEC none | 8.6 |
| Two Way MLR 5 day | 1.4 | HPAEC TNF alpha + IL-1 beta | 3.5 |
| Two Way MLR 7 day | 4.1 | Lung fibroblast none | 2.7 |
| PBMC rest | 2.5 | Lung fibroblast TNF alpha + IL-1 beta | 2.9 |
| PBMC PWM | 2.3 | Lung fibroblast IL-4 | 2.9 |
| VPBMC PHA-L | 0.4 | Lung fibroblast IL-9 | 4.0 |
| Ramos (B cell) none | 0.0 | Lung fibroblast IL-13 | 5.5 |
| Ramos (B cell) ionomycin | 0.0 | Lung fibroblast IFN gamma | 5.8 |
| B lymphocytes PWM | 0.0 | Dermal fibroblast CCD1070 rest | 16.2 |
| B lymphocytes CD40L and IL-4 | 7.6 | Dermal fibroblast CCD1070 TNF alpha | 4.7 |
| EOL-1 dbcAMP | 1.9 | Dermal fibroblast CCD1070 IL-1 beta | 1.8 |
| EOL-1 dbcAMP PMA/ionomycin | 5.5 | Dermal fibroblast IFN gamma | 6.7 |
| Dendritic cells none | 1.6 | Dermal fibroblast IL-4 | 4.1 |
| Dendritic cells LPS | 0.0 | Dermal Fibroblasts rest | 12.2 |
| Dendritic cells anti-CD40 | 0.7 | Neutrophils TNFa + LPS | 0.7 |
| Monocytes rest | 2.8 | Neutrophils rest | 1.5 |

TABLE RI-continued

Panel 4.1D

| Tissue Name | Rel. Exp. (%) Ag3948, Run 170684837 | Tissue Name | Rel. Exp. (%) Ag3948, Run 170684837 |
|---|---|---|---|
| Monocytes LPS | 9.3 | Colon | 5.5 |
| Macrophages rest | 0.0 | Lung | 11.6 |
| Macrophages LPS | 0.8 | Thymus | 40.6 |
| HUVEC none | 0.3 | Kidney | 100.0 |
| HUVEC starved | 9.9 | | |

TABLE RJ

Panel 4D

| Tissue Name | Rel. Exp. (%) Ag2874, Run 159776813 | Rel. Exp. (%) Ag3532, Run 166444749 | Tissue Name | Rel. Exp. (%) Ag2874, Run 159776813 | Rel. Exp. (%) Ag3532, Run 166444749 |
|---|---|---|---|---|---|
| Secondary Th1 act | 0.0 | 0.0 | HUVEC IL-1 beta | 0.0 | 0.0 |
| Secondary Th2 act | 0.0 | 0.0 | HUVEC IFN gamma | 4.4 | 5.5 |
| Secondary Tr1 act | 0.0 | 7.2 | HUVEC TNF alpha + IFN gamma | 0.0 | 0.0 |
| Secondary Th1 rest | 0.0 | 0.0 | HUVEC TNF alpha + IL4 | 0.0 | 0.0 |
| Secondary Th2 rest | 0.0 | 0.0 | HUVEC IL-11 | 0.0 | 0.0 |
| Secondary Tr1 rest | 0.0 | 3.3 | Lung Microvascular EC none | 0.0 | 9.0 |
| Primary Th1 act | 0.0 | 0.0 | Lung Microvascular EC TNF alpha + IL-1 beta | 0.0 | 0.0 |
| Primary Th2 act | 0.0 | 0.0 | Microvascular Dermal EC none | 0.0 | 0.0 |
| Primary Tr1 act | 0.0 | 0.0 | Microsvascular Dermal EC TNF alpha + IL-1 beta | 0.0 | 0.0 |
| Primary Th1 rest | 0.0 | 6.4 | Bronchial epthelium TNF alpha + IL1 beta | 0.0 | 0.0 |
| Primary Th2 rest | 5.6 | 0.0 | Small airway epithelium none | 5.2 | 21.2 |
| Primary Tr1 rest | 8.6 | 0.0 | Small airway epithelium TNF alpha + IL-1 beta | 25.5 | 19.6 |
| CD45RA CD4 lymphocyte act | 0.0 | 0.0 | Coronery artery SMC rest | 0.0 | 2.1 |
| CD45RO CD4 lymphocyte act | 0.0 | 0.0 | Coronery artery SMC TNF alpha + IL-1 beta | 0.0 | 0.0 |
| CD8 lymphocyte act | 0.0 | 0.0 | Astrocytes rest | 0.0 | 0.0 |
| Secondary CD8 lymphocyte rest | 0.0 | 0.0 | Astrocytes TNF alpha + IL-1 beta | 0.0 | 5.8 |
| Secondary CD8 lymphocyte act | 0.0 | 0.0 | KU-812 (Basophil) rest | 0.0 | 0.0 |
| CD4 lymphocyte none | 4.1 | 6.9 | KU-812 (Basophil) PMA/ionomycin | 0.0 | 3.0 |
| 2ry Th1/Th2/Tr1_anti-CD95 CH11 | 0.0 | 0.0 | CCD1106 (Keratinocytes) none | 13.5 | 6.7 |
| LAK cells rest | 0.0 | 0.0 | CCD1106 (Keratinocytes) TNF alpha + IL-1 beta | 0.0 | 69.3 |
| LAK cells IL-2 | 0.0 | 0.0 | Liver cirrhosis | 0.0 | 0.0 |
| LAK cells IL-2 + IL-12 | 0.0 | 0.0 | Lupus kidney | 0.0 | 4.2 |
| LAK cells IL-2 + IFN gamma | 0.0 | 3.5 | NCI-H292 none | 71.7 | 85.9 |
| LAK cells IL-2 + IL-18 | 0.0 | 0.0 | NCI-H292 IL-4 | 53.6 | 100.0 |
| LAK cells PMA/ionomycin | 0.0 | 0.0 | NCI-H292 IL-9 | 100.0 | 68.8 |

TABLE RJ-continued

Panel 4D

| Tissue Name | Rel. Exp. (%) Ag2874, Run 159776813 | Rel. Exp. (%) Ag3532, Run 166444749 | Tissue Name | Rel. Exp. (%) Ag2874, Run 159776813 | Rel. Exp. (%) Ag3532, Run 166444749 |
|---|---|---|---|---|---|
| NK Cells IL-2 rest | 0.0 | 3.4 | NCI-H292 IL-13 | 36.9 | 60.3 |
| Two Way MLR 3 day | 0.0 | 0.0 | NCI-H292 IFN gamma | 8.1 | 64.2 |
| Two Way MLR 5 day | 0.0 | 7.0 | HPAEC none | 0.0 | 0.0 |
| Two Way MLR 7 day | 0.0 | 0.9 | HPAEC TNF alpha + IL-1 beta | 0.0 | 0.0 |
| PBMC rest | 0.0 | 0.0 | Lung fibroblast none | 0.0 | 0.0 |
| PBMC PWM | 8.2 | 6.9 | Lung fibroblast TNF alpha + IL-1 beta | 4.0 | 4.9 |
| PBMC PHA-L | 0.0 | 0.0 | Lung fibroblast IL-4 | 0.0 | 0.0 |
| Ramos (B cell) none | 0.0 | 0.0 | Lung fibroblast IL-9 | 4.6 | 0.0 |
| Ramos (B cell) ionomycin | 0.0 | 0.0 | Lung fibroblast IL-13 | 0.0 | 0.0 |
| B lymphocytes PWM | 0.0 | 3.4 | Lung fibroblast IFN gamma | 5.0 | 0.0 |
| B lymphocytes CD40L and IL-4 | 0.0 | 5.0 | Dermal fibroblast CCD1070 rest | 4.6 | 3.0 |
| EOL-1 dbcAMP | 0.0 | 0.0 | Dermal fibroblast CCD1070 TNF alpha | 0.0 | 0.0 |
| EOL-1 dbcAMP PMA/ionomycin | 3.7 | 0.0 | Dermal fibroblast CCD1070 IL-1 beta | 0.0 | 0.0 |
| Dendritic cells none | 0.0 | 0.0 | Dermal fibroblast IFN gamma | 4.6 | 6.6 |
| Dendritic cells LPS | 0.0 | 0.0 | Dermal fibroblast IL-4 | 0.0 | 6.5 |
| Dendritic cells anti-CD40 | 0.0 | 2.1 | IBD Colitis 2 | 0.0 | 0.0 |
| Monocytes rest | 4.5 | 0.0 | IBD Crohn's | 0.0 | 0.0 |
| Monocytes LPS | 8.6 | 2.7 | Colon | 12.0 | 13.7 |
| Macrophages rest | 0.0 | 0.0 | Lung | 0.0 | 0.0 |
| Macrophages LPS | 0.0 | 0.0 | Thymus | 0.0 | 7.6 |
| HUVEC none | 0.0 | 0.0 | Kidney | 4.0 | 17.6 |
| HUVEC starved | 0.0 | 3.5 | | | |

CNS_neurodegeneration_v1.0 Summary: Ag3948 This panel does not show differential expression of the CG56062-01 gene in Alzheimer's disease. However, this expression profile confirms the presence of this gene in the brain. Please see Panel General_screening_panel_v1.4 for discussion of utility of this gene in the central nervous system. Ag3532 Expression of the CG56062-01 gene is low/undetectable in all samples on this panel (CTs>35).

General_screening_panel_v1.4 Summary: Ag3948 The expression of the CG56062-01 gene, an organic anion transporter homolog, is highest in a small cell lung cancer line LX-1 (CT=28.2). This gene is also expressed in some ovarian, breast, CNS, gastric, pancreatic, renal and colon cancer cell lines. Therefore, expression of this gene may be associated with these forms of cancer and therapeutic modulation of this gene might be of use in the treatment or diagnosis of these cancers.

This gene is also expressed at low levels in the cerebellum and fetal brain. The organic anion transporters are involved in transport across the blood brain barrier. This gene may therefore be of use in drug delivery to the CNS, specifically for compounds such as nerve growth factors protein therapeutics which are believed to have numerous uses in the CNS, but lack a delivery system. Ag3532 Results from one experiment with this gene are not included. The amp plot indicates that there were instrumental difficulties with this run.

REFERENCES

Sugiyama D, Kusuhara H, Shitara Y, Abe T, Meier P J, Sekine T, Endou H, Suzuki H, Sugiyama Y. Characterization of the efflux transport of 17beta-estradiol-D-17beta-glucuronide from the brain across the blood-brain barrier. J Pharmacol Exp Ther 2001 July; 298(1):316–22

The contribution of organic anion transporters to the total efflux of 17beta-estradiol-D-17beta-glucuronide (E(2)17betaG) through the blood-brain barrier (BBB) was investigated using the Brain Efflux Index method by examining the inhibitory effects of probenecid, taurocholate (TCA), p-aminohippurate (PAH), and digoxin. E(2)17betaG was eliminated through the BBB with a rate constant of 0.037 min(−1) after the microinjection into the brain. Probenecid and TCA inhibited this elimination with an IC50 value of 34 and 1.8 nmol/0.5 microl of injectate, respectively, whereas PAH and digoxin reduced the total efflux to about 80 and 60% of the control value, respectively. The selectivity of these inhibitors was confirmed by examining their inhibitory effects on the transport via organic anion transporting polypeptide 1 (Oatp1), Oatp2, organic anion transporter 1 (Oat1), and Oat3 transfectants using LLC-PK1 cells as hosts. Digoxin specifically inhibited the transport via Oatp2 (K(i)=0.037 microM). The K(i) values of TCA for Oatp1 and Oatp2 (11 and 39 microM, respectively) were about 20 times lower than those for Oat1 and Oat3 (2.8 and 0.8 mM, respectively). PAH did not affect the transport via the Oatp family, but had a similar affinity for Oat1 and Oat3 (85 and 300 microM, respectively). Probenecid had a similar affinity for these transporters (Oatp1, Oatp2, Oat1, and Oat3) examined in this study. Taking the selectivity of these inhibitors into consideration, the maximum contribution made by the Oatp2 and Oat family to the total efflux of E(2)17betaG from the brain appears to be about 40 and 20%, respectively.

Panel 1.3D Summary: Ag2874 The expression of the CG56062-01 gene was assessed in two independent runs on this panel with reasonable concordance between the runs. The highest expression is seen in a small cell lung cancer line LX-1 (CTs=31–32), consistent with expression in Panel 1.3D. This gene is also expressed in some ovarian, breast, CNS, gastric and colon cancer cell lines. Therefore, expression of this gene might be associated with these forms of cancer and therapeutic modulation of this gene might be of use in the treatment or diagnosis of these cancers.

Panel 2D Summary: Ag2874 The CG56062-01 gene is expressed at low levels in the tissues used for panel 2D. The highest expression is seen in a breast cancer sample (CT=34.2). Significant expression is also seen in single samples of ovarian, bladder, prostate and colon cancers compared with the normal adjacent tissue. This indicates that the expression of this gene might be associated with these forms of cancer and therapeutic modulation of this gene might be of use in the treatment or diagnosis of these cancers.

Panel 3D Summary: Ag2874 Highest expression of the CG56062-01 gene is seen in a pancreatic cancer cell line (CT=31.6). Thus, expression of this gene could be used to differentiate between this sample and other samples on this panel.

Panels 4D and 4.1D Summary: Ag2874/Ag3498 The highest expression of the CG56062-01 transcript is found in the kidney and in the pulmonary muco-epidermoid cell line NCI-H292. The expression of this transcript, although constitutive in the H292 cell line, is up regulated upon treatment with IL-4, Il-9 and IL-13, cytokines that have been linked to the pathogenesis of asthma and/or COPD. This transcript is also found in small airway epithelium and keratinocytes treated with the inflammatory cytokines TNF-a and IL-1b. Therefore, modulation of the expression or activity of the protein encoded by this transcript through the application of small molecule therapeutics may be useful in the treatment of asthma, COPD, emphysema, psoriasis and wound healing.

NOV25f, NOV25b, NOV25e, NOV25g, NOV25a, and NOV26: CG56653-01, CG56653-02, CG56653-06, CG56653-09, 152736829, and 152736833: Ficolin Expression of gene CG56653-01 and CG56653-02 and CG56653-06 and CG56653-09 and 152736829 and 152736833 was assessed using the primer-probe sets Ag1446, Ag5126 and Ag4934, described in Tables SA, SB and SC. Results of the RTQ-PCR runs are shown in Tables SD, SE, SF, SG, SE and SI. Please note that CG56653-09, a splice variant of CG56653-01, is the only variant that corresponds to the Ag5126 probe/primer set. This does not impact the results presented below.

TABLE SA

Probe Name Ag1446

| Primers | Sequences | Length | Start Position |
|---------|-----------|--------|----------------|
| Forward | 5'-cgctgtcctgctagtcttgtt-3' (SEQ ID NO:443) | 21 | 218 |
| Probe | TET-5'-atatcaagaacctgcctgcccaggct-3'-TAMRA (SEQ ID NO:444) | 26 | 244 |
| Reverse | 5'-ccttcacctctggacatgtg-3' (SEQ ID NO:445) | 20 | 275 |

TABLE SB

Probe Name Ag5126

| Primers | Sequences | Length | Start Position |
|---------|-----------|--------|----------------|
| Forward | 5'-cagctgggggtaattctc-3' (SEQ ID NO:446) | 19 | 726 |
| Probe | TET-5'caacttcttctccaccaaagaccaagaca-3'-TAMRA (SEQ ID NO:447) | 29 | 761 |
| Reverse | 5'-gcacaattcgaagaactcacat-3' (SEQ ID NO:448) | 22 | 793 |

TABLE SC

Probe Name Ag4934

| Primers | Sequences | Length | Start Position |
|---------|-----------|--------|----------------|
| Forward | 5'-cgctgtcctgctagtcttgtt-3' (SEQ ID No:449) | 21 | 218 |
| Probe | TET-5'-atatcaagaacctgcctgcccaggct-3'-TAMRA (SEQ ID NO:450) | 26 | 244 |
| Reverse | 5'-ccttcacctctggacatgtg-3' (SEQ ID NO:451) | 20 | 275 |

TABLE SD

AI_comprehensive panel_v1.0

| Tissue Name | Rel. Exp. (%) Ag1446, Run 211195015 | Rel. Exp. (%) Ag1446, Run 212650184 | Tissue Name | Rel. Exp. (%) Ag1446, Run 211195015 | Rel. Exp. (%) Ag1446, Run 212650184 |
|---|---|---|---|---|---|
| 119067 COPD-F | 3.3 | 1.4 | 112427 Match Control Psoriasis-F | 11.0 | 2.1 |

TABLE SD-continued

AI_comprehensive panel_v1.0

| Tissue Name | Rel. Exp. (%) Ag1446, Run 211195015 | Rel. Exp. (%) Ag1446, Run 212650184 | Tissue Name | Rel. Exp. (%) Ag1446, Run 211195015 | Rel. Exp. (%) Ag1446, Run 212650184 |
|---|---|---|---|---|---|
| 110980 COPD-F | 4.8 | 1.0 | 112418 Psoriasis-M | 2.9 | 1.1 |
| 110968 COPD-M | 3.5 | 0.5 | 112723 Match Control Psoriasis-M | 0.9 | 0.4 |
| 110977 COPD-M | 14.9 | 6.3 | 112419 Psoriasis-M | 5.5 | 2.6 |
| 110989 Emphysema-F | 7.4 | 2.8 | 112424 Match Control Psoriasis-M | 1.8 | 0.9 |
| 110992 Emphysema-F | 3.6 | 2.2 | 112420 Psoriasis-M | 10.2 | 3.3 |
| 110993 Emphysema-F | 6.0 | 1.9 | 112425 Match Control Psoriasis-M | 5.6 | 1.8 |
| 110994 Emphysema-F | 3.3 | 1.6 | 104689 (MF) OA Bone-Backus | 62.0 | 20.3 |
| 110995 Emphysema-F | 4.3 | 2.1 | 104690 (MF) Adj "Normal" Bone-Backus | 23.7 | 6.0 |
| 110996 Emphysema-F | 1.6 | 1.2 | 104691 (MF) OA Synovium-Backus | 10.2 | 5.2 |
| 110997 Asthma-M | 7.6 | 2.6 | 104692 (BA) OA Cartilage-Backus | 0.8 | 0.0 |
| 1111001 Asthma-F | 15.6 | 8.3 | 104694 (BA) OA Bone-Backus | 49.0 | 16.0 |
| 111002 Asthma-F | 20.3 | 6.7 | 104695 (BA) Adj "Normal" Bone-Backus | 19.9 | 7.9 |
| 111003 Atopic Asthma-F | 10.7 | 3.7 | 104696 (BA) OA Synovium-Backus | 16.3 | 5.2 |
| 111004 Atopic Asthma-F | 7.2 | 0.0 | 104700 (SS) OA Bone-Backus | 100.0 | 100.0 |
| 1111005 Atopic Asthma-F | 3.7 | 1.0 | 104701 (SS) Adj "Normal" Bone-Backus | 29.7 | 7.0 |
| 111006 Atopic Asthma-F | 0.0 | 0.0 | 104702 (SS) OA Synovium-Backus | 27.7 | 9.3 |
| 111417 Allergy-M | 4.1 | 1.7 | 1117093 OA Cartilage Rep7 | 3.3 | 0.0 |
| 112347 Allergy-M | 0.4 | 0.0 | 112672 OA Bone5 | 23.3 | 5.1 |
| 112349 Normal Lung-F | 0.5 | 0.0 | 112673 OA Synovium5 | 7.1 | 2.6 |
| 112357 Normal Lung-F | 6.7 | 2.8 | 112674 OA Synovial Fluid cells5 | 9.1 | 3.7 |
| 112354 Normal Lung-M | 0.5 | 0.4 | 117100 OA Cartilage Rep14 | 2.4 | 1.3 |
| 112374 Crohns-F | 2.7 | 0.0 | 112756 OA Bone9 | 3.9 | 0.7 |
| 112389 Match trol Crohns-F | 3.5 | 1.7 | 112757 OA Synovium9 | 2.3 | 2.7 |
| 112375 Crohns-F | 0.0 | 0.2 | 112758 OA Synovial Fluid Cells9 | 14.3 | 3.6 |
| 112732 Match Control Crohns-F | 10.2 | 2.8 | 117125 RA Cartilage Rep2 | 3.6 | 1.0 |
| 112725 Crohns-M | 11.0 | 2.4 | 113492 Bone2 RA | 45.4 | 11.2 |
| 112387 Match Control Crohns-M | 4.9 | 2.3 | 1113493 Synovium2 RA | 13.9 | 3.5 |
| 112378 Crohns-M | 0.0 | 0.3 | 113494 Syn Fluid Cells RA | 29.7 | 10.7 |
| 112390 Match Control Crohns-M | 0.8 | 0.3 | 113499 Cartilage4 RA | 14.9 | 6.8 |
| 112726 Crohns-M | 5.1 | 2.2 | 113500 Bone4 RA | 16.0 | 5.4 |
| 112731 Match Control Crohn-M | 3.1 | 3.3 | 113501 Synovium4 RA | 11.7 | 5.2 |
| 112380 Ulcer Col-F | 1.8 | 0.5 | 113502 Syn Fluid Cells4 RA | 7.7 | 4.2 |
| 112734 Match Control Ulcer Col-F | 40.6 | 19.1 | 113495 Cartilage3 RA | 26.6 | 12.5 |
| 112384 Ulcer Col-F | 10.7 | 3.8 | 113496 Bone3 RA | 34.6 | 8.5 |
| 112737 Match Control Ulcer Col-F | 2.0 | 1.5 | 113497 Synovium3 RA | 15.4 | 6.4 |
| 112386 Ulcer Col-F | 4.0 | 2.5 | 113498 Syn Fluid Cells3 RA | 33.7 | 12.8 |
| 112738 Match Control Ulcer Col-F | 54.3 | 12.0 | 117106 Normal Cartilage Rep20 | 0.5 | 0.6 |

TABLE SD-continued

AI_comprehensive panel_v1.0

| Tissue Name | Rel. Exp. (%) Ag1446, Run 211195015 | Rel. Exp. (%) Ag1446, Run 212650184 | Tissue Name | Rel. Exp. (%) Ag1446, Run 211195015 | Rel. Exp. (%) Ag1446, Run 212650184 |
|---|---|---|---|---|---|
| 112381 Ulcer Col-M | 0.0 | 0.0 | 113663 Bone3 Normal | 0.0 | 0.3 |
| 112735 Match Control Ulcer Col-M | 3.4 | 1.8 | 113664 Synovium3 Normal | 0.0 | 0.0 |
| 112382 Ulcer Col-M | 4.9 | 1.0 | 113665 Syn Fluid Cells3 Normal | 0.8 | 0.0 |
| 112394 Match Control Ulcer Col-M | 3.7 | 1.4 | 117107 Normal Cartilage Rep22 | 2.4 | 1.4 |
| 112383 Ulcer Col-M | 11.2 | 3.0 | 113667 Bone4 Normal | 0.8 | 0.5 |
| 112736 Match Control Ulcer Col-M | 4.6 | 0.5 | 113668 Synovium4 Normal | 0.6 | 0.9 |
| 112423 Psoriasis-F | 23.3 | 11.7 | 113669 Syn Fluid Cells4 Normal | 2.4 | 0.4 |

TABLE SE

CNS_neurodegeneration_v1.0

| Tissue Name | Rel. Exp. (%) Ag1446, Run 206992271 | Rel. Exp. (%) Ag5126, Run 226203926 | Tissue Name | Rel. Exp. (%) Ag1446, Run 206992271 | Rel. Exp. (%) Ag5126, Run 226203926 |
|---|---|---|---|---|---|
| AD 1 Hippo | 13.7 | 0.0 | Control (Path) 3 Temporal Ctx | 1.7 | 0.0 |
| AD 2 Hippo | 28.7 | 0.0 | Control (Path) 4 Temporal Ctx | 27.2 | 29.3 |
| AD 3 Hippo | 0.0 | 0.0 | AD 1 Occipital Ctx | 12.4 | 0.0 |
| AD 4 Hippo | 0.0 | 0.0 | AD 2 Occipital Ctx (Missing) | 0.0 | 0.0 |
| AD 5 Hippo | 34.6 | 17.9 | AD 3 Occipital Ctx | 6.9 | 0.0 |
| AD 6 Hippo | 87.1 | 0.0 | AD 4 Occipital Ctx | 8.4 | 0.0 |
| Control 2 Hippo | 0.0 | 0.0 | AD 5 Occipital Ctx | 22.5 | 26.4 |
| Control 4 Hippo | 3.3 | 13.5 | AD 6 Occipital Ctx | 20.0 | 0.0 |
| Control (Path) 3 Hippo | 4.6 | 0.0 | Control 1 Occipital Ctx | 88.9 | 100.0 |
| AD 1 Temporal Ctx | 15.2 | 0.0 | Control 2 Occipital Ctx | 14.4 | 9.9 |
| AD 2 Temporal Ctx | 6.6 | 0.0 | Control 3 Occipital Ctx | 14.8 | 0.0 |
| AD 3 Temporal Ctx | 8.8 | 0.0 | Control 4 Occipital Ctx | 13.4 | 0.0 |
| AD 4 Temporal Ctx | 2.0 | 0.0 | Control (Path) 1 Occipital Ctx | 18.0 | 0.0 |
| AD 5 Inf Temporal Ctx | 28.9 | 0.0 | Control (Path) 2 Occipital Ctx | 0.0 | 0.0 |
| AD 5 Sup Temporal Ctx | 38.7 | 0.0 | Control (Path) 3 Occipital Ctx | 6.8 | 0.0 |
| AD 6 Inf Temporal Ctx | 64.6 | 0.0 | Control (Path) 4 Occipital Ctx | 20.7 | 38.4 |
| AD 6 Sup Temporal Ctx | 100.0 | 34.9 | Control 1 Parietal Ctx | 87.1 | 30.8 |
| Control 1 Temporal Ctx | 57.8 | 27.5 | Control 2 Parietal Ctx | 28.7 | 0.0 |
| Control 2 Temporal Ctx | 8.0 | 0.0 | Control 3 Parietal Ctx | 1.5 | 0.0 |
| Control 3 Temporal Ctx | 3.4 | 14.5 | Control (Path) 1 Parietal Ctx | 7.6 | 0.0 |
| Control 3 Temporal Ctx | 15.7 | 10.9 | Control (Path) 2 Parietal Ctx | 12.2 | 24.3 |
| Control (Path) 1 Temporal Ctx | 26.2 | 13.9 | Control (Path) 3 Parietal Ctx | 3.8 | 0.0 |
| Control (Path) 2 Temporal Ctx | 0.0 | 14.4 | Control (Path) 4 Parietal Ctx | 24.5 | 54.3 |

TABLE SF

General_screening_panel_v1.5

| Tissue Name | Rel. Exp. (%) Ag4934, Run 228843453 | Rel. Exp. (%) Ag5126, Run 228783295 | Tissue Name | Rel. Exp. (%) Ag4934, Run 228843453 | Rel. Exp. (%) Ag5126, Run 228783295 |
| --- | --- | --- | --- | --- | --- |
| Adipose | 48.6 | 29.9 | Renal ca. TK-10 | 0.0 | 0.0 |
| Melanoma* Hs688(A).T | 0.0 | 0.0 | Bladder | 6.4 | 6.2 |
| Melanoma* Hs688(B).T | 0.0 | 0.0 | Gastric ca. (liver met.) NCI-N87 | 0.0 | 0.0 |
| Melanoma* M14 | 0.0 | 0.0 | Gastric ca. KATO III | 0.0 | 0.0 |
| Melanoma* LOXIMVI | 0.0 | 0.0 | Colon Ca. SW-948 | 0.0 | 0.0 |
| Melanoma* SK-MEL-5 | 4.8 | 0.0 | Colon Ca. SW480 | 0.0 | 0.0 |
| Squamous cell carcinoma SSC-4 | 0.0 | 0.0 | Colon ca.* (SW480 met) SW620 | 0.0 | 0.0 |
| Testis Pool | 1.4 | 0.0 | Colon ca. HT29 | 0.0 | 0.0 |
| Prostate ca.* (bone met) PC-3 | 0.0 | 0.0 | Colon ca. HCT-116 | 0.0 | 0.0 |
| Prostate Pool | 9.3 | 6.8 | Colon ca. CaCo-2 | 0.0 | 0.0 |
| Placenta | 26.8 | 32.5 | Colon cancer tissue | 35.6 | 23.3 |
| Uteras Pool | 12.4 | 0.0 | Colon Ca. SW1116 | 0.0 | 0.0 |
| Ovarian ca. OVCAR-3 | 0.0 | 0.0 | Colon Ca. Colo-205 | 0.0 | 0.0 |
| Ovarian ca. SK-OV-3 | 0.0 | 0.0 | Colon ca. SW-48 | 0.0 | 0.0 |
| Ovarian ca. OVCAR-4 | 0.0 | 0.0 | Colon Pool | 68.8 | 33.0 |
| Ovarian ca. OVCAR-5 | 0.0 | 0.0 | Small Intestine Pool | 9.4 | 3.7 |
| Ovarian Ca. IGROV-1 | 0.0 | 0.0 | Stomach Pool | 7.5 | 0.0 |
| Ovarian Ca. OVCAR-8 | 0.0 | 0.0 | Bone Marrow Pool | 8.5 | 9.1 |
| Ovary | 4.6 | 10.0 | Fetal Heart | 5.4 | 4.9 |
| Breast ca. MCF-7 | 0.0 | 0.0 | Heart Pool | 9.9 | 4.6 |
| Breast Ca. MDA-MB-231 | 0.0 | 0.0 | Lymph Node Pool | 8.9 | 8.1 |
| Breast Ca. BT 549 | 0.0 | 0.0 | Fetal Skeletal Muscle | 7.2 | 12.6 |
| Breast Ca. T47D | 0.0 | 0.0 | Skeletal Muscle Pool | 17.4 | 8.5 |
| Breast Ca. MDA-N | 0.0 | 0.0 | Spleen Pool | 84.7 | 95.3 |
| Breast Pool | 25.3 | 15.4 | Thymus Pool | 16.8 | 10.6 |
| Trachea | 24.3 | 20.3 | CNS cancer (glio/astro) U87-MG | 0.0 | 0.0 |
| Lung | 0.7 | 0.0 | CNS cancer (glio/astro) U-118-MG | 0.0 | 0.0 |
| Fetal Lung | 100.0 | 100.0 | CNS cancer (neuro;met) SK-N-AS | 0.0 | 0.0 |
| Lung Ca. NCI-N417 | 0.0 | 0.0 | CNS cancer (astro) SF-539 | 0.0 | 0.0 |
| Lung ca. LX-1 | 0.0 | 0.0 | CNS cancer (astro) SNB-75 | 0.0 | 0.0 |
| Lung ca. NCI-H146 | 0.0 | 0.0 | CNS cancer (glio) SNB-19 | 0.0 | 0.0 |
| Lung ca. SHP-77 | 0.0 | 0.0 | CNS cancer (glio) SF-295 | 0.0 | 0.0 |
| Lung ca. A549 | 0.0 | 0.0 | Brain (Amygdala) Pool | 1.8 | 0.0 |
| Lung ca. NCI-H526 | 0.0 | 0.0 | Brain (cerebellum) | 1.4 | 6.3 |
| Lung ca. NCI-H23 | 0.0 | 0.0 | Brain (fetal) | 3.6 | 0.0 |
| Lung ca. NCI-H460 | 0.0 | 0.0 | Brain (Hippocampus) Pool | 2.0 | 0.0 |
| Lung ca. HOP-62 | 0.0 | 0.0 | Cerebral Cortex Pool | 1.9 | 0.0 |
| Lung ca. NCI-H522 | 0.0 | 0.0 | Brain (Substantianigra) Pool | 1.7 | 0.0 |
| Liver | 2.2 | 5.4 | Brain (Thalamus) Pool | 1.4 | 0.0 |
| Fetal Liver | 28.5 | 21.0 | Brain (whole) | 3.7 | 4.1 |
| Liver ca. HepG2 | 0.0 | 0.0 | Spinal Cord Pool | 3.1 | 0.0 |
| Kidney Pool | 18.6 | 12.2 | Adrenal Gland | 6.0 | 8.8 |
| Fetal Kidney | 7.5 | 8.2 | Pituitary gland Pool | 0.7 | 0.0 |
| Renal Ca. 786-0 | 0.0 | 0.0 | Salivary Gland | 5.9 | 3.9 |
| Renal Ca. A498 | 0.0 | 0.0 | Thyroid (female) | 15.0 | 15.1 |
| Renal ca. ACHN | 0.0 | 0.0 | Pancreatic Ca. CAPAN2 | 0.0 | 0.0 |
| Renal ca. UO-31 | 0.0 | 0.0 | Pancreas Pool | 27.9 | 22.8 |

TABLE SG

Panel 1.2

| Tissue Name | Rel. Exp. (%) Ag1446, Run 140179219 | Tissue Name | Rel. Exp. (%) Ag1446, Run 140179219 |
|---|---|---|---|
| Endothelial cells | 0.0 | Renal ca. 786-0 | 0.0 |
| Heart (Fetal) | 0.7 | Renal ca. A498 | 0.0 |
| Pancreas | 0.1 | Renal ca. RXF 393 | 0.0 |
| Pancreatic ca. CAPAN2 | 0.0 | Renal ca. ACHN | 0.0 |
| Adrenal Gland | 1.4 | Renal ca. UO-31 | 0.0 |
| Thyroid | 0.1 | Renal ca. TK-10 | 0.0 |
| Salivary gland | 1.1 | Liver | 3.7 |
| Pituitary gland | 0.1 | Liver (fetal) | 2.5 |
| Brain (fetal) | 0.0 | Liver ca. (hepatoblast) HepG2 | 0.0 |
| Brain (whole) | 0.0 | Lung | 1.2 |
| Brain (amygdala) | 0.1 | Lung (fetal) | 0.4 |
| Brain (cerebellum) | 0.0 | Lung ca. (small cell) LX-1 | 0.0 |
| Brain (hippocampus) | 0.1 | Lung ca. (small cell) NCI-H69 | 0.0 |
| Brain (thalamus) | 0.1 | Lung ca. (s.cell var.) SHP-77 | 0.0 |
| Cerebral Cortex | 0.1 | Lung ca. (large cell) NCI-H460 | 0.0 |
| Spinal cord | 0.1 | Lung ca. (non-sm. cell) A549 | 0.0 |
| glio/astro U87-MG | 0.0 | Lung ca. (non-s.cell) NCI-H23 | 0.0 |
| glio/astro U-118-MG | 0.0 | Lung ca. (non-s.cell) HOP-62 | 0.0 |
| astrocytoma SW1783 | 0.0 | Lung ca. (non-s.cl) NCI-H522 | 0.0 |
| neuro*; met SK-N-AS | 0.0 | Lung ca. (squam.) SW 900 | 0.0 |
| astrocytoma SF-539 | 0.0 | Lung ca. (squam.) NCI-H596 | 0.0 |
| astrocytoma SNB-75 | 0.0 | Mammary gland | 0.2 |
| glioma SNB-19 | 0.0 | Breast ca.* (pl.ef) MCF7 | 0.0 |
| glioma U251 | 0.0 | Breast ca.* (pl.ef) MDA-MB-231 | 0.0 |
| glioma SF-295 | 0.0 | Breast ca.* (pl.ef) T47D | 0.0 |
| Heart | 1.7 | Breast ca. BT-549 | 0.0 |
| Skeletal Muscle | 0.9 | Breast ca. MDA-N | 0.0 |
| Bone marrow | 100.0 | Ovary | 0.8 |
| Thymus | 0.2 | Ovarian OVCAR-3 | 0.0 |
| Spleen | 3.5 | Ovarian ca. OVCAR-4 | 0.0 |
| Lymph node | 0.2 | Ovarian ca. OVCAR-5 | 0.0 |
| Colorectal Tissue | 0.2 | Ovarian ca. OVCAR-8 | 0.0 |
| Stomach | 0.1 | Ovarian Ca. IGROV-1 | 0.0 |
| Small intestine | 0.3 | Ovarian ca. (ascites) SK-OV-3 | 0.0 |
| Colon ca. SW480 | 0.0 | Uterus | 0.2 |
| Colon ca.* SW620 (SW480 met) | 0.0 | Placenta | 2.4 |
| Colon ca. HT29 | 0.0 | Prostate | 0.4 |
| Colon ca. HCT-116 | 0.0 | Prostate ca.* (bone met) PC-3 | 0.0 |
| Colon ca. CaCo-2 | 0.0 | Testis | 0.0 |
| Colon ca. Tissue (ODO3866) | 0.2 | Melanoma Hs688(A).T | 0.0 |
| Colon ca. HCC-2998 | 0.0 | Melanoma* (met) Hs688(B).T | 0.0 |
| Gastric ca.* (liver met) NCI-N87 | 0.0 | Melanoma UACC-62 | 0.0 |
| Bladder | 0.7 | Melanoma M14 | 0.0 |
| Trachea | 0.1 | Melanoma LOX IMVI | 0.0 |
| Kidney | 0.8 | Melanoma* (met) SK-MEL-5 | 0.0 |
| Kidney (fetal) | 0.7 | | |

TABLE SH

Panel 4.1D

| Tissue Name | Rel. Exp. (%) Ag4934, Run 223597255 | Rel. Exp. (%) Ag5126, Run 225784392 | Tissue Name | Rel. Exp. (%) Ag4934, Run 223597255 | Rel. Exp. (%) Ag5126, Run 225784392 |
|---|---|---|---|---|---|
| Secondary Th1 act | 0.0 | 0.0 | HUVEC IL-1 beta | 0.0 | 0.0 |
| Secondary Th2 act | 0.0 | 0.0 | HUVEC IFN gamma | 0.0 | 0.0 |
| Secondary Tr1 act | 0.0 | 0.0 | HUVEC TNF alpha + IFN gamma | 0.0 | 0.0 |
| Secondary Th1 rest | 0.0 | 0.0 | HUVEC TNF alpha + IL4 | 0.0 | 0.0 |
| Secondary Th2 rest | 0.0 | 0.0 | HUVEC IL-11 | 0.0 | 0.0 |
| Secondary Tr1 rest | 0.0 | 0.0 | Lung Microvascular EC none | 0.0 | 0.0 |
| Primary Th1 act | 0.0 | 0.0 | Lung Microvascular EC TNF alpha + IL-1 beta | 0.0 | 0.0 |
| Primary Th2 act | 0.0 | 0.0 | Microvascular Dermal EC none | 0.0 | 0.0 |
| Primary Tr1 act | 0.0 | 0.0 | Microsvascular Dermal EC TNF alpha + IL-1 beta | 0.0 | 0.0 |
| Primary Th1 rest | 0.0 | 0.0 | Bronchial epithelium TNF alpha + IL1 beta | 0.0 | 0.0 |
| Primary Th2 rest | 0.0 | 0.0 | Small airway epithelium none | 0.0 | 0.0 |
| Primary Tr1 rest | 0.0 | 0.0 | Small airway epithelium + IL-1 beta | 0.0 | 0.0 |

TABLE SH-continued

Panel 4.1D

| Tissue Name | Rel. Exp. (%) Ag4934, Run 223597255 | Rel. Exp. (%) Ag5126, Run 225784392 | Tissue Name | Rel. Exp. (%) Ag4934, Run 223597255 | Rel. Exp. (%) Ag5126, Run 225784392 |
|---|---|---|---|---|---|
| CD45RA CD4 lymphocyte act | 0.0 | 0.0 | Coronery artery SMC rest | 0.0 | 0.0 |
| CD45RO CD4 lymphocyte act | 0.0 | 0.0 | Coronery artery SMC TNF alpha + IL-1 beta | 0.0 | 0.0 |
| CD8 lymphocyte act | 0.0 | 0.0 | Astrocytes rest | 0.0 | 0.0 |
| Secondary CD8 lymphocyte rest | 0.0 | 0.0 | Astrocytes TNF alpha + IL-1 beta | 0.0 | 0.0 |
| Secondary CD8 lymphocyte act | 0.0 | 0.0 | KU-812 (Basophil) rest | 0.0 | 0.0 |
| CD4 lymphocyte none | 0.5 | 0.5 | KU-812 (Basophil) PMA/ionomycin | 0.0 | 0.0 |
| 2 ry Th1/Th2/Tr1_anti-CD95 CH11 | 0.0 | 0.0 | CCD1106 (Keratinocytes) none | 0.0 | 0.0 |
| LAK cells rest | 6.9 | 8.5 | CCD1106 (Keratinocytes) TNF alpha + IL-1 beta | 0.0 | 0.0 |
| LAK cells IL-2 | 0.0 | 0.0 | Liver cirrhosis | 0.2 | 0.0 |
| LAK cells IL-2 + IL-12 | 0.0 | 0.0 | NCI-H292 none | 0.0 | 0.0 |
| LAK cells IL-2 + IFN gamma | 0.0 | 0.1 | NCI-H292 IL-4 | 0.0 | 0.0 |
| LAK cells IL-2 + IL-18 | 0.0 | 0.1 | NCI-H292 IL-9 | 0.0 | 0.0 |
| LAK cells PMA/ionomycin | 8.2 | 9.5 | NCI-H292 IL-13 | 0.0 | 0.0 |
| NK Cells IL-2 rest | 0.0 | 0.0 | NCI-H292 IFN gamma | 0.0 | 0.0 |
| Two Way MLR 3 day | 1.0 | 1.1 | HPAEC none | 0.0 | 0.0 |
| Two Way MLR 5 day | 0.1 | 0.2 | HPAEC TNF alpha + IL-1 beta | 0.0 | 0.0 |
| Two Way MLR 7 day | 0.0 | 0.0 | Lung fibroblast none | 0.0 | 0.0 |
| PBMC rest | 19.2 | 19.3 | Lung fibroblast TNF alpha + IL-1 beta | 0.0 | 0.0 |
| PBMC PWM | 0.0 | 0.0 | Lung fibroblast IL-4 | 0.0 | 0.0 |
| PBMC PHA-L | 0.0 | 0.0 | Lung fibroblast IL-9 | 0.0 | 0.0 |
| Ramos (B cell) none | 0.0 | 0.0 | Lung fibroblast IL-13 | 0.0 | 0.0 |
| Ramos (B cell) ionomycin | 0.0 | 0.0 | Lung fibroblast IFN gamma | 0.0 | 0.0 |
| B lymphocytes PWM | 0.0 | 0.0 | Dermal fibroblast CCD1070 rest | 0.0 | 0.0 |
| B lymphocytes CD40L and IL-4 | 0.0 | 0.0 | Dermal fibroblast CCD1070 TNF alpha | 0.0 | 0.0 |
| EOL-1 dbcAMP | 3.5 | 3.2 | Dermal fibroblast CCD1070 IL-1 beta | 0.1 | 0.0 |
| EOL-1 dbcAMP PMA/ionomycin | 0.5 | 0.3 | Dermal fibroblast IFN gamma | 0.1 | 0.1 |
| Dendritic cells none | 1.0 | 1.7 | Dermal fibroblast IL-4 | 0.3 | 0.3 |
| Dendritic cells LPS | 0.1 | 0.1 | Dermal Fibrobtasts rest | 0.1 | 0.2 |
| Dendritic cells anti-CD40 | 0.6 | 0.7 | Neutrophils TNFa + LPS | 1.8 | 2.4 |
| Monocytes rest | 100.0 | 100.0 | Neutrophils rest | 3.8 | 5.5 |
| Monocytes LPS | 4.8 | 3.6 | Colon | 0.0 | 0.0 |
| Macrophages rest | 4.1 | 4.1 | Lung | 0.3 | 0.3 |
| Macrophages LPS | 1.8 | 2.1 | Thymus | 0.2 | 0.1 |
| HUVEC none | 0.0 | 0.0 | Kidney | 0.1 | 0.1 |
| HUVEC starved | 0.0 | 0.0 | | | |

TABLE SI

Panel 4D

| Tissue Name | Rel. Exp. (%) Ag1446, Run 162699707 | Tissue Name | Rd. Exp. (%) Ag1446, Run 162699707 | Tissue Name | Rel. Exp. (%) Ag1446, Run 162699707 | Tissue Name | Rd. Exp. (%) Ag1446, Run 162699707 |
|---|---|---|---|---|---|---|---|
| Secondary Th1 act | 0.0 | HUVEC IL-1beta | 0.0 | Secondary Tr1 act | 0.0 | HUVEC TNF alpha + IFN gamma | 0.0 |
| Secondary Th2 act | 0.0 | HUVEC IFN gamma | 0.0 | | | | |

TABLE SI-continued

Panel 4D

| Tissue Name | Rel. Exp. (%) Ag1446, Run 162699707 | Tissue Name | Rd. Exp. (%) Ag1446, Run 162699707 |
|---|---|---|---|
| Secondary Th1 rest | 0.0 | HUVEC TNF alpha + IL4 | 0.0 |
| Secondary Th2 rest | 0.0 | HUVEC IL-11 | 0.0 |
| Secondary Tr1 rest | 0.0 | Microvascular EC none | 0.0 |
| Primary Th1 act | 0.0 | Lung Microvascular EC TNF alpha + IL-1 beta | 0.0 |
| Primary Th2 act | 0.0 | Microvascular Dermal EC none | 0.0 |
| Primary Tr1 act | 0.0 | Microsvascular Dermal EC TNF alpha + IL-1 beta | 0.0 |
| Primary Th1 rest | 0.0 | Bronchial epithelium TNF alpha + IL1 beta | 0.0 |
| Primary Th2 rest | 0.0 | Small airway epithelium none | 0.0 |
| Primary Tr1 rest | 0.0 | Small airway epithelium TNF alpha + IL-1 beta | 0.0 |
| CD45RA CD4 lymphocyte act | 0.0 | Coronery artery SMC rest | 0.0 |
| CD45RO CD4 lymphocyte act | 0.0 | Coronery artery SMC TNF alpha + IL-1 beta | 0.0 |
| CD8 lymphocyte act | 0.0 | Astrocytes rest | 0.0 |
| Secondary CD8 lymphocyte rest | 0.0 | Astrocytes TNF alpha + IL-1 beta | 0.0 |
| Secondary CD8 lymphocyte act | 0.0 | KU-812 (Basophil) rest | 0.0 |
| CD4 lymphocyte none | 0.4 | KU-812 (Basophil) PMA/ionomycin | 0.0 |
| 2ry Th1/Th2/Tr1_anti-CD95 CH11 | 0.0 | CCD1106 (Keratinocytes) none | 0.0 |
| LAK cells rest | 9.4 | CCD1106 (Keratinocytes) TNF alpha + IL-1beta | 0.0 |
| LAK cells IL-2 | 0.0 | Liver cirrhosis | 0.1 |
| LAK cells IL-2 + IL-12 | 0.0 | Lupus kidney | 0.0 |
| LAK cells IL-2 + IFN gamma | 0.0 | NCI-H292 none | 0.0 |
| LAK cells IL-2 + IL-18 | 0.1 | NCI-H292 IL-4 | 0.0 |
| LAK cells PMA/ionomycin | 8.1 | NCI-H292 IL-9 | 0.0 |
| NK Cells IL-2 rest | 0.0 | NCI-H292 IL-13 | 0.0 |
| Two Way MLR 3 day | 0.8 | NCI-H292 IFN gamma | 0.0 |
| Two Way MLR 5 day | 0.1 | HPAEC none | 0.0 |
| Two Way MLR 7 day | 0.0 | HPAEC TNF alpha + IL-1 beta | 0.0 |
| PBMC rest | 14.8 | Lung fibroblast none | 0.0 |
| PBMC PWM | 0.0 | Lung fibroblast TNF alpha + IL-1 beta | 0.0 |
| PBMC PHA-L | 0.0 | Lung fibroblast IL-4 | 0.0 |
| Ramos (B cell) none | 0.0 | Lung fibroblast IL-9 | 0.0 |
| Ramos (B cell) ionomycin | 0.0 | Lung fibroblast IL-13 | 0.0 |
| B lymphocytes PWM | 0.0 | Lung fibroblast IFN gamma | 0.0 |
| B lymphocytes CD40L and IL-4 | 0.0 | Dermal fibroblast CCD1070 rest | 0.0 |
| EOL-1 dbcAMP | 2.5 | Dermal fibroblast CCD1070 TNF alpha | 0.0 |
| EOL-1 dbcAMP PMA/ionomycin | 0.7 | Dermal fibroblast CCD1070 IL-1 beta | 0.0 |
| Dendritic cells none | 1.2 | Dermal fibroblast IFN gamma | 0.0 |
| Dendritic cells LPS | 0.1 | Dermal fibroblast IL-4 | 0.0 |
| Dendritic cells anti-CD40 | 0.5 | IBD Colitis 2 | 0.0 |
| Monocytes rest | 100.0 | IBD Crohn's | 0.0 |
| Monocytes LPS | 2.1 | Colon | 0.1 |
| Macrophages rest | 3.6 | Lung | 0.4 |
| Macrophages LPS | 0.9 | Thymus | 0.1 |
| HUVEC none | 0.0 | Kidney | 0.2 |
| HUVEC starved | 0.0 | | |

AI_comprehensivse panel_v1.0 Summary: Ag 1446 Two experiments with the same probe and primer set produce results that are in excellent agreement, with expression of the CG56653-01 gene essentially limited to bone from OA and RA patients. Low to undetectable expression is found in normal bone. Low expression is also found in colon. This transcript encodes a putative ficolin 1 precursor. Ficolins are multimeric lectins that are capable of binding to bacteria. It has been reported to function as a monocyte cell surface molecule important for binding to bacteria, elastin and monocyte adhesion. Therefore, ficolin may play a role in the inflammation of joints in patients suffering from osteoarthritis (OA) and/or rheumatoid arthritis (RA). Antibodies against proteins encoded by this transcript may thus prevent tissue destruction mediated by ficolin activity during osteoarthritis and arthritis.

CNS_neurodegeneration_v1.0 Summary: Ag1446/Ag5126 Expression of the CG56653-01 gene is low/undetectable in all samples on this panel (CTs>35).

General_screening panel_v1.5 Summary: Ag4934/Ag5126 Two experiments with different probe and primer sets show highest expression of the CG56653-01 gene in the fetal lung (CTs=31–34). Expression of this gene is also higher in fetal lung and fetal liver (CT=33) than in their adult counterparts (CTs=38–40). Thus expression of this gene could be used to differentiate between the two sources of lung and liver tissue. In addition, low but significant levels of expression in adipose, heart, skeletal muscle, thyroid and pancreas suggest that modulation of this gene product may be a treatment for metabolic or endocrine disease including obesity and Types 1 and 2 diabetes.

Panel 1.2 Summary: Ag1446 The CG56653-01 gene is most highly expressed in bone marrow (CT=22). Thus, expression of this gene could be used to differentiate between this sample and other samples on this panel. In addition, this gene has low-to-moderate levels of expression (CT values=27–33) in many metabolic tissues including liver, heart, skeletal muscle, thyroid, pancreas, adrenal and pituitary, as seen in General_screening_panel_v1.5. Thus, modulation of this gene product may be a treatment for metabolic or endocrine disease including obesity and Types 1 and 2 diabetes.

Panel 4D/4.1D Summary: Ag1446/Ag4934/Ag5126 Multiple experiments show the CG56653-01 gene highly and selectively expressed in resting monocytes and to a lesser extent in macrophages and granulocytes (neutrophils and EOL cell line), in agreement with published expression profiles. This transcript encodes a putative ficolin 1 precursor. Ficolins are multimeric lectins that are capable of binding to bacteria. It has been reported to function as a monocyte cell surface molecule that is important for binding to bacteria, elastin and monocyte adhesion. Ficolin may also play a role in alleviating inflammation in joints and other sites of inflammation. Therefore, protein therapeutics designed with the protein encoded by this transcript could function as an opsinin to target and eliminate bacteria by complement-mediated destruction. These proteins could also be important for the treatment of bacterial septicemia. In addition, ficolins may have the ability to bind to elastins. Elastins are functionally important for lung alveolar development and inactivation of these proteins can lead to emphysema-like disease. Therefore, antibodies against proteins encoded by this transcript may prevent tissue destruction mediated by ficolin activity during emphysema, asthma and arthritis.

REFERENCES

Harumiya S, Takeda K, Sugiura T, Fukumoto Y, Tachikawa H, Miyazono K, Fujimoto D, Ichijo H. Characterization of ficolins as novel elastin-binding proteins and molecular cloning of human ficolin-1 J Biochem (Tokyo) 1996 October; 120(4):745–51

A novel elastin-binding protein, EBP-37, was recently identified and purified from human plasma. Its partial amino acid sequences showed significant homology to porcine ficolins, which were originally purified from porcine uterus membranes as multimeric proteins with fibrinogen- and collagen-like domains. Here we report the presence of ficolins in an elastin-binding fraction of porcine plasma and the direct binding of recombinant porcine ficolin-alpha to elastin. In addition, a cDNA encoding a human counterpart of porcine ficolins that is composed of 319 amino acids and is different from EBP-37 was cloned and named human ficolin-1. Northern blotting of various human tissues revealed that human ficolin-1 mRNA is highly expressed in peripheral blood leukocytes. These data suggested that there are at least two kinds of ficolin-related proteins in both pig and human, and they may function as plasma proteins with elastin-binding activities.

PMID: 8947836

Teh C, Le Y, Lee S H, Lu J. Immunology 2000 October; 101(2):225–32M-ficolin is expressed on monocytes and is a lectin binding to N-acetyl-D-glucosamine and mediates monocyte adhesion and phagocytosis of *Escherichia coli.*

Ficolins are a group of multimeric proteins that contain collagen-like and fibrinogen-like (FBG) sequences. Three types of ficolins have been characterized: H—, L- and M-ficolins. Both H- and L-ficolins have demonstrated lectin activities. In the present study, the FBG domain of M-ficolin was expressed and shown to bind to N-acetyl-D-glucosamine. M-ficolin mRNA was expressed in monocytes but not in the more differentiated macrophages and dendritic cells. By flow cytometry, surface biotinylation and immunoprecipitation, we showed that M-ficolin was associated with the surface of promonocytic U937 cells. M-ficolin transiently expressed in COS-7 cells was also clearly detected on the cell surface by immunoprecipitation. By flow cytometry, M-ficolin was detected on peripheral blood monocytes but not on lymphocytes or granulocytes. Immobilized rabbit anti-M-ficolin F(ab')2 mediated U937 cell adhesion, and the antibody also inhibited phagocytosis of *Escherichia coli* K-12 by U937 cells. Therefore, M-ficolin might act as a phagocytic receptor or adaptor on circulating monocytes for micro-organism recognition and may potentially mediate monocyte adhesion.

PMID: 11012776

NOV27: CG56262-01: Ca-Binding Transporter

Expression of gene CG56262-01 was assessed using the primer-probe sets Ag2896 and Ag2920, described in Tables TA and TB. Results of the RTQ-PCR runs are shown in Tables TC, TD, TE and TF.

TABLE TA

Probe Name Ag2896

| Primers | Sequences | Length | Start Position |
|---|---|---|---|
| Forward | 5'-gtcagcttctcttgctttgaga-3' (SEQ ID NO: 452) | 22 | 900 |
| Probe | TET-5'-cactgtcaggcactcgccaatgt-3'-TAMRA (SEQ ID NO: 453) | 23 | 932 |
| Reverse | 5'-ctgtatttctggaagcattcca-3' (SEQ ID NO: 454) | 22 | 964 |

TABLE TB

Probe Name Ag2920

| Primers | Sequences | Length | Start Position |
|---|---|---|---|
| Forward | 5'-ttgatgtctctgagatccaaca-3' (SEQ ID NO: 455) | 22 | 1134 |
| Probe | TET-5'-agtttccgagctctgggcatttccat-3'-TAMRA (SEQ ID NO: 456) | 26 | 1107 |
| Reverse | 5'-catgctgtgcaaaattttctc-3' (SEQ ID NO: 457) | 21 | 1070 |

TABLE TC

CNS_neurodegeneration_v1.0

| Tissue Name | Rel. Exp. (%) Ag2896, Run 209734744 | Rel. Exp.(%) Ag2920, Run 209779301 | Tissue Name | Rel. Exp.(%) Ag2896, Run 209734744 | Rel. Exp. (%) Ag2920, Run 209779301 |
|---|---|---|---|---|---|
| AD 1 Hippo | 17.7 | 21.6 | Control (Path) 3 Temporal Ctx | 11.0 | 15.3 |
| AD 2 Hippo | 41.5 | 40.3 | Control (Path) 4 Temporal Ctx | 41.2 | 36.9 |
| AD 3 Hippo | 13.9 | 18.2 | AD 1 Occipital Ctx | 10.7 | 13.1 |
| AD 4 Hippo | 10.7 | 11.3 | AD 2 Occipital Ctx (Missing) | 0.0 | 0.0 |
| AD 5 Hippo | 65.1 | 54.7 | AD 3 Occipital Ctx | 8.1 | 9.2 |
| AD 6 Hippo | 62.4 | 73.2 | AD 4 Occipital Ctx | 23.5 | 25.3 |
| Control 2 Hippo | 45.4 | 51.8 | AD 5 Occipital Ctx | 45.4 | 15.7 |
| Control 4 Hippo | 15.8 | 19.8 | AD 6 Occipital Ctx | 14.7 | 44.4 |
| Control (Path) 3 Hippo | 10.6 | 12.9 | Control 1 Occipital Ctx | 6.8 | 8.4 |
| AD 1 Temporal Ctx | 17.6 | 18.9 | Control 2 Occipital Ctx | 52.1 | 57.4 |
| AD 2 Temporal Ctx | 41.5 | 41.8 | Control 3 Occipital Ctx | 14.3 | 18.8 |
| AD 3 Temporal Ctx | 10.1 | 12.9 | Control 4 Occipital Ctx | 11.0 | 12.3 |
| AD 4 Temporal Ctx | 29.9 | 27.5 | Control (Path) 1 Occipital Ctx | 80.7 | 100.0 |
| AD 5 Inf Temporal Ctx | 78.5 | 79.6 | Control (Path) 2 Occipital Ctx | 11.1 | 11.5 |
| AD 5 Sup Temporal Ctx | 47.0 | 43.5 | Control (Path) 3 Occipital Ctx | 5.3 | 7.0 |
| AD 6 Inf Temporal Ctx | 48.0 | 47.6 | Control (Path) 4 Occipital Ctx | 14.2 | 12.3 |
| AD 6 Sup Temporal Ctx | 47.3 | 55.5 | Control 1 Parietal Ctx | 13.8 | 15.4 |
| Control 1 Temporal Ctx | 14.8 | 16.6 | Control 2 Parietal Ctx | 40.6 | 40.6 |
| Control 2 Temporal Ctx | 53.6 | 66.9 | Control 3 Parietal Ctx | 2.8 | 17.8 |
| Control 3 Temporal Ctx | 24.3 | 22.8 | Control (Path) 1 Parietal Ctx | 100.0 | 100.0 |
| Control 3 Temporal Ctx | 18.0 | 15.8 | Control (Path) 2 Parietal Ctx | 25.0 | 23.2 |
| Control (Path) 1 Temporal Ctx | 86.5 | 88.3 | Control (Path) 3 Parietal Ctx | 7.1 | 9.7 |
| Control (Path) 2 Temporal Ctx | 45.1 | 50.0 | Control (Path) 4 Parietal Ctx | 46.3 | 47.6 |

TABLE TD

Panel 1.3D

| Tissue Name | Rel. Exp.(%) Ag2896, Run 167660338 | Rel. Exp.(%) Ag2920, Run 167646813 | Tissue Name | Rel. Exp.(%) Ag2896, Run 167660338 | Rel. Exp.(%) Ag2920, Run 167646813 |
|---|---|---|---|---|---|
| Liver adenocarcinoma | 36.6 | 40.1 | Kidney (fetal) | 23.2 | 21.6 |
| Pancreas | 4.2 | 7.4 | Renal ca. 786-0 | 15.5 | 19.6 |
| Pancreatic ca. CAPAN 2 | 10.1 | 9.3 | Renal ca. A498 | 9.5 | 9.4 |
| Adrenal gland | 3.3 | 2.8 | Renal ca. RXF 393 | 17.3 | 16.6 |
| Thyroid | 11.8 | 18.9 | Renal ca. ACHN | 10.5 | 14.5 |
| Salivary gland | 6.7 | 6.6 | Renal ca. UO-31 | 7.7 | 9.9 |
| Pituitary gland | 2.2 | 2.7 | Renal ca. TK-10 | 12.4 | 14.7 |
| Brain (fetal) | 27.0 | 27.7 | Liver | 4.3 | 3.5 |
| Brain (whole) | 81.2 | 74.2 | Liver (fetal) | 1.8 | 2.6 |
| Brain (amygdala) | 40.1 | 40.3 | Liver ca. (hepatoblast) HepG2 | 4.7 | 4.9 |
| Brain (cerebellum) | 30.8 | 33.0 | Lung | 5.4 | 3.2 |
| Brain (hippocampus) | 44.8 | 42.0 | Lung (fetal) | 4.8 | 4.7 |
| Brain (substantia nigra) | 23.0 | 21.5 | Lung ca. (small cell) LX-1 | 6.7 | 6.2 |
| Brain (thalamus) | 25.5 | 31.6 | Lung ca. (small cell) NCI-H69 | 0.0 | 0.1 |
| Cerebral Cortex | 100.0 | 100.0 | Lung ca. (s. cell var.) SHP-77 | 26.1 | 31.9 |
| Spinal cord | 12.6 | 12.9 | Lung ca. (large cell) NCI-H460 | 1.2 | 1.4 |
| glio/astro U87-MG | 2.2 | 2.4 | Lung ca. (non-sm. cell) A549 | 10.4 | 8.9 |
| glio/astro U-118-MG | 9.9 | 8.1 | Lung ca. (non-s. cell)NCI-H23 | 11.0 | 12.7 |
| astrocytoma SW1783 | 8.8 | 10.1 | Lung ca. (non-s. cell) HOP-62 | 4.9 | 4.7 |
| neuro*; met SK-N-AS | 4.2 | 3.3 | Lung ca. (non-s.cl) NCI-H522 | 11.4 | 11.4 |
| astrocytoma SF-539 | 5.8 | 5.4 | Lung ca. (squam.) SW 900 | 7.9 | 8.6 |
| astrocytoma SNB-75 | 10.2 | 10.5 | Lung ca. (squam.) NCI-H596 | 0.3 | 0.4 |
| glioma SNB-19 | 10.1 | 11.0 | Mammary gland | 8.3 | 8.5 |
| glioma U251 | 14.1 | 15.8 | Breast ca* (pl.ef) MCF-7 | 7.5 | 8.1 |
| glioma SF-295 | 6.0 | 5.9 | Breast ca.* (pl.ef) MDA-MB-231 | 6.6 | 7.1 |
| Heart (fetal) | 38.7 | 40.1 | Breast ca.* (pl.ef) T47D | 16.2 | 17.0 |
| Heart | 10.7 | 9.9 | Breast ca. BT-549 | 5.8 | 5.1 |
| Skeletal muscle (fetal) | 16.0 | 11.8 | Breast ca. MDA-N | 19.5 | 22.5 |
| Skeletal muscle | 31.2 | 28.7 | Ovary | 10.4 | 10.3 |
| Bone marrow | 0.4 | 0.6 | Ovarian ca. OVCAR-3 | 11.5 | 9.2 |
| Thymus | 2.5 | 2.5 | Ovarian ca. OVCAR-4 | 35.6 | 32.5 |
| Spleen | 1.1 | 1.4 | Ovarian ca. OVCAR-5 | 31.0 | 34.2 |
| Lymph node | 2.6 | 1.7 | Ovarian ca. OVCAR-8 | 5.4 | 5.5 |

TABLE TD-continued

Panel 1.3D

| Tissue Name | Rel. Exp.(%) Ag2896, Run 167660338 | Rel. Exp.(%) Ag2920, Run 167646813 | Tissue Name | Rel. Exp.(%) Ag2896, Run 167660338 | Rel. Exp.(%) Ag2920, Run 167646813 |
|---|---|---|---|---|---|
| Colorectal | 14.0 | 12.3 | Ovarian ca. IGROV-1 | 10.3 | 10.2 |
| Stomach | 4.4 | 4.0 | Ovarian ca.* (ascites) SK-OV-3 | 13.8 | 18.0 |
| Small intestine | 4.4 | 4.9 | Uterus | 6.3 | 8.4 |
| Colon ca. SW480 | 5.1 | 5.3 | Placenta | 0.0 | 0.0 |
| Colon ca.* SW620(SW480 met) | 14.9 | 18.7 | Prostate | 3.2 | 3.8 |
| Colon ca. HT29 | 6.8 | 7.2 | Prostate ca.* (bone met)PC-3 | 16.5 | 18.3 |
| Colon ca. HCT-116 | 10.7 | 10.4 | Testis | 1.4 | 1.3 |
| Colon ca. CaCo-2 | 17.0 | 21.9 | Melanoma Hs688(A).T | 2.8 | 2.6 |
| Colon ca. tissue(ODO3866) | 2.4 | 2.4 | Melanoma* (met) Hs688(B).T | 2.6 | 3.8 |
| Colon ca. HCC-2998 | 9.3 | 7.6 | Melanoma UACC-62 | 10.9 | 11.2 |
| Gastric ca.* (liver met) NCI-N87 | 5.7 | 5.5 | Melanoma M14 | 8.6 | 5.8 |
| Bladder | 5.1 | 5.1 | Melanoma LOX IMVI | 12.2 | 10.8 |
| Trachea | 1.9 | 2.8 | Melanoma* (met) SK-MEL-5 | 24.0 | 25.2 |
| Kidney | 12.4 | 17.0 | Adipose | 6.1 | 6.4 |

TABLE TE

Panel 4D

| Tissue Name | Rel. Exp.(%) Ag2896, Run 164401737 | Rel. Exp.(%) Ag2920, Run 164403312 | Tissue Name | Rel. Exp.(%) Ag2896, Run 164401737 | Rel. Exp.(%) Ag2920, Run 164403312 |
|---|---|---|---|---|---|
| Secondary Th1 act | 5.6 | 7.3 | HUVEC IL-1beta | 4.9 | 4.3 |
| Secondary Th2 act | 6.8 | 6.0 | HUVEC IFN gamma | 19.6 | 19.8 |
| Secondary Tr1 act | 7.4 | 7.7 | HUVEC TNF alpha + IFN gamma | 7.8 | 8.9 |
| Secondary Th1 rest | 6.4 | 6.7 | HUVEC TNF alpha + IL4 | 6.1 | 7.9 |
| Secondary Th2 rest | 7.6 | 7.1 | HUVEC IL-11 | 10.4 | 11.8 |
| Secondary Tr1 rest | 12.2 | 9.7 | Lung Microvascular EC none | 7.5 | 9.8 |
| Primary Th1 act | 12.7 | 14.5 | Lung Microvascular EC TNFalpha + IL-1beta | 5.5 | 6.1 |
| Primary Th2 act | 16.0 | 15.1 | Microvascular Dermal EC none | 13.7 | 12.6 |
| Primary Tr1 act | 26.4 | 22.1 | Microsvascular Dermal EC TNFalpha + IL-1beta | 5.7 | 6.6 |
| Primary Th1 rest | 31.6 | 33.4 | Bronchial epithelium TNFalpha + IL1beta | 15.9 | 11.9 |
| Primary Th2 rest | 19.3 | 18.7 | Small airway epithelium none | 4.7 | 5.3 |

TABLE TE-continued

Panel 4D

| Tissue Name | Rel. Exp.(%) Ag2896, Run 164401737 | Rel. Exp.(%) Ag2920, Run 164403312 | Tissue Name | Rel. Exp.(%) Ag2896, Run 164401737 | Rel. Exp.(%) Ag2920, Run 164403312 |
|---|---|---|---|---|---|
| Primary Tr1 rest | 14.7 | 16.5 | Small airway epithelium TNFalpha + IL-1beta | 35.6 | 37.1 |
| CD45RA CD4 lymphocyte act | 6.2 | 5.1 | Coronery artery SMC rest | 7.1 | 6.7 |
| CD45RO CD4 lymphocyte act | 11.2 | 12.3 | Coronery artery SMC TNFalpha + IL-1beta | 4.6 | 5.9 |
| CD8 lymphocyte act | 11.6 | 10.8 | Astrocytes rest | 27.0 | 23.8 |
| Secondary CD8 lymphocyte rest | 8.2 | 9.9 | Astrocytes TNFalpha + IL-1beta | 30.8 | 28.1 |
| Secondary CD8 lymphocyte act | 3.0 | 3.3 | KU-812 (Basophil) rest | 8.2 | 6.3 |
| CD4 lymphocyte none | 2.8 | 3.4 | KU-812 (Basophil) PMA/ionomycin | 22.5 | 19.9 |
| 2ry Th1/Th2/Tr1_anti-CD95 CH11 | 7.3 | 7.4 | CCD1106 (Keratinocytes) none | 11.1 | 11.7 |
| LAK cells rest | 7.1 | 6.7 | CCD1106 (Keratinocytes) TNFalpha + IL-1beta | 6.8 | 6.3 |
| LAK cells IL-2 | 14.7 | 17.0 | Liver cirrhosis | 3.0 | 3.0 |
| LAK cells IL-2 + IL-12 | 6.9 | 7.0 | Lupus kidney | 6.5 | 6.2 |
| LAK cells IL-2 + IFN gamma | 12.8 | 11.0 | NCI-H292 none | 63.3 | 72.7 |
| LAK cells IL-2 + IL-18 | 6.7 | 9.0 | NCI-H292 IL-4 | 57.4 | 69.7 |
| LAK cells PMA/ionomycin | 0.9 | 0.6 | NCI-H292 IL-9 | 57.0 | 65.5 |
| NK Cells IL-2 rest | 7.2 | 6.5 | NCI-H292 IL-13 | 30.8 | 35.6 |
| Two Way MLR 3 day | 6.3 | 6.8 | NCI-H292 IFN gamma | 29.3 | 34.4 |
| Two Way MLR 5 day | 3.5 | 3.0 | HPAEC none | 10.8 | 11.7 |
| Two Way MLR 7 day | 4.2 | 4.5 | HPAEC TNF alpha + IL-1 beta | 6.9 | 6.4 |
| PBMC rest | 2.0 | 1.6 | Lung fibroblast none | 16.8 | 17.4 |
| PBMC PWM | 27.9 | 26.2 | Lung fibroblast TNF alpha + IL-1 beta | 7.4 | 8.0 |
| PBMC PHA-L | 27.5 | 26.8 | Lung fibroblast IL-4 | 30.6 | 34.6 |
| Ramos (B cell) none | 16.8 | 16.0 | Lung fibroblast IL-9 | 24.8 | 24.1 |
| Ramos (B cell) ionomycin | 100.0 | 100.0 | Lung fibroblast IL-13 | 19.6 | 21.8 |
| B lymphocytes PWM | 36.6 | 22.8 | Lung fibroblast IFN gamma | 31.4 | 37.6 |
| B lymphocytes CD40L and IL-4 | 13.5 | 14.9 | Dermal fibroblast CCD1070 rest | 10.7 | 12.0 |
| EOL-1 dbcAMP | 14.5 | 15.5 | Dermal fibroblast CCD1070 TNF alpha | 20.6 | 21.3 |
| EOL-1 dbcAMP PMA/ionomycin | 7.1 | 6.3 | Dermal fibroblast CCD1070 IL-1 beta | 6.5 | 5.9 |
| Dendritic cells none | 0.8 | 1.5 | Dermal fibroblast IFN gamma | 10.1 | 11.3 |
| Dendritic cells LPS | 0.1 | 0.2 | Dermal fibroblast IL-4 | 23.0 | 23.2 |
| Dendritic cells anti-CD40 | 0.9 | 0.7 | IBD Colitis 2 | 2.0 | 2.3 |
| Monocytes rest | 0.1 | 0.0 | IBD Crohn's | 3.4 | 4.8 |
| Monocytes LPS | 0.2 | 0.0 | Colon | 41.5 | 50.7 |
| Macrophages rest | 4.0 | 3.4 | Lung | 15.8 | 17.2 |

TABLE TE-continued

Panel 4D

| Tissue Name | Rel. Exp.(%) Ag2896, Run 164401737 | Rel. Exp.(%) Ag2920, Run 164403312 | Tissue Name | Rel. Exp.(%) Ag2896, Run 164401737 | Rel. Exp.(%) Ag2920, Run 164403312 |
|---|---|---|---|---|---|
| Macrophages LPS | 0.5 | 0.4 | Thymus | 57.8 | 55.5 |
| HUVEC none | 12.2 | 12.8 | Kidney | 5.0 | 8.5 |
| HUVEC starved | 21.6 | 20.4 | | | |

TABLE TF

Panel CNS_1

| Tissue Name | Rel. Exp.(%) Ag2896, Run 171688452 | Tissue Name | Rel. Exp.(%) Ag2896, Run 171688452 |
|---|---|---|---|
| BA4 Control | 22.1 | BA17 PSP | 22.4 |
| BA4 Control2 | 41.8 | BA17 PSP2 | 6.5 |
| BA4 Alzheimer's2 | 5.2 | Sub Nigra Control | 21.3 |
| BA4 Parkinson's | 39.2 | Sub Nigra Control2 | 18.3 |
| BA4 Parkinson's2 | 68.8 | Sub Nigra Alzheimer's2 | 7.2 |
| BA4 Huntington's | 28.1 | Sub Nigra Parkinson's2 | 27.7 |
| BA4 Huntington's2 | 13.9 | Sub Nigra Huntington's | 25.5 |
| BA4 PSP | 9.9 | Sub Nigra Huntington's2 | 13.6 |
| BA4 PSP2 | 25.5 | Sub Nigra PSP2 | 3.4 |
| BA4 Depression | 22.7 | Sub Nigra Depression | 6.3 |
| BA4 Depression2 | 6.7 | Sub Nigra Depression2 | 6.1 |
| BA7 Control | 34.9 | Glob Palladus Control | 18.9 |
| BA7 Control2 | 27.7 | Glob Palladus Control2 | 19.9 |
| BA7 Alzheimer's2 | 6.2 | Glob Palladus Alzheimer' | 7.2 |
| BA7 Parkinson's | 18.3 | Glob Palladus Alzheimer's2 | 9.8 |
| BA7 Parkinson's2 | 38.2 | Glob Palladus Parkinson's | 100.0 |
| BA7 Huntington's | 51.1 | Glob Palladus Parkinson's2 | 20.9 |
| BA7 Huntington's2 | 38.7 | Glob Palladus PSP | 13.8 |
| BA7 PSP | 44.4 | Glob Palladus PSP2 | 12.4 |
| BA7 PSP2 | 18.9 | Glob Palladus Depression | 7.5 |
| BA7 Depression | 10.5 | Temp Pole Control | 20.0 |
| BA9 Control | 27.9 | Temp Pole Control2 | 66.9 |
| BA9 Control2 | 83.5 | Temp Pole Alzheimer's | 6.1 |
| BA9 Alzheimer's | 4.7 | Temp Pole Alzheimer's2 | 6.6 |
| BA9 Alzheimer's2 | 12.6 | Temp Pole Parkinson's | 34.6 |
| BA9 Parkinson's | 22.5 | Temp Pole Parkinson's2 | 24.0 |
| BA9 Parkinson's2 | 45.4 | Temp Pole Huntington's | 33.4 |
| BA9 Huntington's | 39.2 | Temp Pole PSP | 8.4 |
| BA9 Huntington's2 | 20.0 | Temp Pole PSP2 | 6.4 |
| BA9 PSP | 12.1 | Temp Pole Depression2 | 6.7 |
| BA9 PSP2 | 3.9 | Cing Gyr Control | 53.6 |
| BA9 Depression | 8.5 | Cing Gyr Control2 | 34.6 |
| BA9 Depression2 | 9.2 | Cing Gyr Alzheimer's | 15.9 |
| BA17 Control | 25.3 | Cing Gyr Alzheimer's2 | 12.2 |
| BA17 Control2 | 34.6 | Cing Gyr Parkinson's | 24.5 |
| BA17 Alzheimer's2 | 4.3 | Cing Gyr Parkinson's2 | 30.8 |
| BA17 Parkinson's | 20.0 | Cing Gyr Huntington's | 48.0 |
| BA17 Parkinson's2 | 28.3 | Cing Gyr Huntington's2 | 16.4 |
| BA17 Huntington's | 24.1 | Cing Gyr PSP | 15.2 |
| BA17 Huntington's2 | 12.1 | Cing Gyr PSP2 | 6.0 |
| BA17 Depression | 8.7 | Cing Gyr Depression | 7.3 |
| BA17 Depression2 | 16.6 | Cing Gyr Depression2 | 11.7 |

CNS_neurodegeneration_v1.0 Summary: Ag2896/Ag2920 This panel does not show differential expression of the CG56153-01 gene in Alzheimer's disease. However, this expression profile confirms the presence of this gene in the brain. Please see Panel 1.3D for discussion of utility of this gene in the central nervous system.

Panel 1.3D Summary: Ag2896/Ag2920 Two experiments produce results that are in excellent agreement, with highest expression of the CG56262-01 gene in the brain. This gene encodes a Ca binding transporter. Ca++ is critical for synaptic vesicle release. Thus, this gene would be an excellent small molecule target for any disease believed to result from altered/inappropriate synaptic transmission such as epilepsy, schizophrenia, bipolar disorder, depression, and mania.

This gene also has moderate levels of expression adult and fetal heart, skeletal muscle and liver, and adipose. This gene product is homologous to a mitochondrial calcium-dependent transporter. Since intracellular calcium homeostasis is critically important for energy metabolism and signal transduction, modulation of this gene product may therefore be a therapeutic for metabolic and endocrine diseases.

Moderate expression in also seen in almost all cell lines on this panel. This suggests that expression of this gene product is required for cell growth and proliferaton in almost all cell types.

REFERENCES

Kovacs I, Szarics E, Nyitrai G, Blandl T, Kardos J. Matching kinetics of synaptic vesicle recycling and enhanced neurotransmitter influx by Ca2+ in brain plasma membrane vesicles. Neurochem Int 1998 November; 33(5):399–405

Using native plasma membrane vesicle suspensions from the rat cerebral cortex under conditions designed to alter intravesicular [Ca2+], we found that Ca2+ induced 47+/−5% more influx of [3H]GABA, [3H]D-aspartate and [3H]glycine at 37 degrees C. with half-times 1.7+/−0.5, 1.3+/−0.4 and 1.3+/−0.4 min, respectively. We labelled GABA transporter sites with the uptake inhibitor, [3H]-(R,S)-N-[4,4-bis(3-methyl-2-thienyl)but-3-en-1-yl]nipecotic acid and found that Ca2+ induced a partial dissociation of the bound inhibitor from GABA transporter sites with a similar half-time. By means of rapid kinetic techniques applied to native plasma membrane vesicle suspensions, containing synaptic vesicles stained with the amphipathic fluorescent styryl membrane probe N-(3-triethylammoniumpropyl)-4-[4-(dibutylamino) styryl]pyrid inium dibromide, we have measured the progress of the release and reuptake of synaptic vesicles in response to Ca2+ and high-[K+] depolarization in the 0.0004–100 s range of time. Synaptic vesicle exocytosis, strongly influenced by external [Ca2+], appeared with the kinetics accelerated by depolarization. These results are consistent with the potential involvement of Ca2+ in taking low-affinity transporters to the plasma membrane surface via exocytosis.

Panel 4D Summary: Ag2896/Ag2920 Two experiments show moderate to low expression of the CG56262-01 transcript across a wide range of cells of this panel including epithelium, fibroblasts, and endothelial cells. Lower but still significant levels of expression are also seen in the key players of innate and adaptive immunity: monocytes/macrophages, T and B cells. However, the expression of this transcript is highest in the B lymphoma cell line, and NCI H292, a mucoepidermoid cell line (CTs=26.4–27). Thus, inhibition of the function of the protein encoded by this transcript with a small molecule drug, could lead to improvement of the symptoms of patients suffering from autoimmune and inflammatory diseases such as asthma, COPD, emphysema, psoriasis, inflammatory bowel disease, lupus erythematosus, or rheumatoid arthritis.

Panel CNS_1 Summary: Ag2896 This expression profile confirms the presence of this gene in the brain. Please see Panel 1.3D for discussion of utility of this gene in the central nervous system.

NOV28: CG56559-01: Na(+)/Glucose Cotransporter

Expression of gene CG56559-01 was assessed using the primer-probe sets Ag2950 and Ag2966, described in Tables UA and UB. Results of the RTQ-PCR runs are shown in Tables UC, UD, UE and UF.

TABLE UA

Probe Name Ag2950

| Primers | Sequences | Length | Start Position |
|---|---|---|---|
| Forward | 5'-ttggtcatagtggcactcatc-3' (SEQ ID NO: 458) | 21 | 1302 |
| Probe | TET-5'-aggactccaacagcgggcaactctt-3'-TAMRA (SEQ ID NO: 459) | 25 | 1354 |
| Reverse | 5'-ggtcactgactgcatgtagatg-3' (SEQ ID NO: 460) | 22 | 1379 |

TABLE UB

Probe Name Ag2966

| Primers | Sequences | Length | Start Position |
|---|---|---|---|
| Forward | 5'-agcgggcaactcttcatcta-3' (SEQ ID NO: 461) | 20 | 1365 |
| Probe | TET-5'-atgcagtcagtgaccagctccctg-3'-TAMRA (SEQ ID NO: 462) | 24 | 1386 |
| Reverse | 5'-caggacaaagactgcagtcact-3' (SEQ ID NO: 463) | 22 | 1418 |

TABLE UC.

Panel 1.3D

| Tissue Name | Rel. Exp.(%) Ag2950, Run 167907051 | Rel. Exp.(%) Ag2966, Run 160658385 | Rel. Exp.(%) Ag2966, Run 165701959 | Tissue Name | Rel. Exp.(%) Ag2950, Run 167907051 | Rel. Exp.(%) Ag2966, Run 160658385 | Rel. Exp.(%) Ag2966, Run 165701959 |
|---|---|---|---|---|---|---|---|
| Liver adenocarcinoma | 0.0 | 0.0 | 0.0 | Kidney (fetal) | 0.0 | 1.0 | 0.0 |
| Pancreas | 0.0 | 0.2 | 1.3 | Renal ca. 786-0 | 0.0 | 0.2 | 0.0 |
| Pancreatic ca. CAPAN 2 | 0.0 | 0.0 | 0.0 | Renal ca. A498 | 0.0 | 0.0 | 0.3 |
| Adrenal gland | 0.0 | 0.2 | 0.0 | Renal ca. RXF 393 | 0.0 | 0.0 | 0.5 |
| Thyroid | 0.0 | 0.3 | 0.0 | Renal ca. ACHN | 0.0 | 0.3 | 0.0 |
| Salivary gland | 0.0 | 0.1 | 0.4 | Renal ca. UO-31 | 0.0 | 0.0 | 0.0 |
| Pituitary gland | 0.0 | 0.0 | 0.0 | Renal ca. TK-10 | 0.0 | 0.0 | 0.0 |
| Brain (fetal) | 0.0 | 0.0 | 0.0 | Liver | 0.0 | 0.6 | 0.9 |
| Brain (whole) | 0.0 | 0.0 | 0.3 | Liver (fetal) | 0.0 | 0.4 | 0.0 |

TABLE UC.-continued

Panel 1.3D

| Tissue Name | Rel. Exp.(%) Ag2950, Run 167907051 | Rel. Exp.(%) Ag2966, Run 160658385 | Rel. Exp.(%) Ag2966, Run 165701959 | Tissue Name | Rel. Exp.(%) Ag2950, Run 167907051 | Rel. Exp.(%) Ag2966, Run 160658385 | Rel. Exp.(%) Ag2966, Run 165701959 |
|---|---|---|---|---|---|---|---|
| Brain (amygdala) | 0.0 | 0.0 | 0.0 | Liver ca. (hepatoblast) HepG2 | 0.0 | 0.3 | 0.0 |
| Brain (cerebellum) | 0.0 | 0.0 | 0.0 | Lung | 0.0 | 0.8 | 0.6 |
| Brain (hippocampus) | 0.0 | 0.5 | 0.3 | Lung (fetal) | 0.0 | 1.4 | 1.4 |
| Brain (substantia nigra) | 0.0 | 0.0 | 0.0 | Lung ca. (small cell) LX-1 | 0.0 | 0.6 | 0.0 |
| Brain (thalamus) | 0.0 | 0.0 | 0.5 | Lung ca. (small cell) NCI-H69 | 0.0 | 0.0 | 0.0 |
| Cerebral Cortex | 0.0 | 0.0 | 0.0 | Lung ca. (s.cell var.) SHP-77 | 0.0 | 0.3 | 0.4 |
| Spinal cord | 0.0 | 0.2 | 0.2 | Lung ca. (large cell)NCI-H460 | 0.0 | 0.2 | 0.0 |
| glio/astro U87-MG | 0.0 | 0.0 | 0.0 | Lung ca. (non-sm. cell) A549 | 0.0 | 0.8 | 0.7 |
| glio/astro U-118-MG | 0.0 | 0.0 | 0.0 | Lung ca. (non-s.cell) NCI-H23 | 0.0 | 0.0 | 0.0 |
| astrocytoma SW1783 | 0.0 | 0.0 | 0.0 | Lung ca. (non-s.cell) HOP-62 | 0.0 | 1.6 | 2.2 |
| neuro*; met SK-N-AS | 0.0 | 0.0 | 0.4 | Lung ca. (non-s.cl) NCI-H522 | 0.0 | 0.5 | 0.0 |
| astrocytoma SF-539 | 0.0 | 0.0 | 0.0 | Lung ca. (squam.) SW 900 | 0.0 | 0.0 | 0.0 |
| astrocytoma SNB-75 | 0.0 | 0.0 | 0.0 | Lung ca. (squam.) NCI-H596 | 0.0 | 0.0 | 0.0 |
| glioma SNB-19 | 0.0 | 0.0 | 0.4 | Mammary gland | 0.0 | 0.3 | 0.7 |
| glioma U251 | 0.0 | 0.0 | 0.4 | Breast ca.* (pl.ef) MCF-7 | 0.0 | 0.2 | 0.0 |
| glioma SF-295 | 0.0 | 0.0 | 0.0 | Breat ca.* (pl.ef) MDA-MB-231 | 0.0 | 0.0 | 0.0 |
| Heart (fetal) | 0.0 | 0.0 | 0.0 | Breast ca.* (pl.ef) T47D | 0.0 | 0.0 | 0.0 |
| Heart | 0.0 | 0.0 | 0.0 | Breast ca. BT-549 | 0.0 | 0.2 | 0.0 |
| Skeletal muscle (fetal) | 0.0 | 3.9 | 0.3 | Breast ca. MDA-N | 0.0 | 0.0 | 0.0 |
| Skeletal muscle | 0.0 | 0.0 | 0.0 | Ovary | 0.0 | 0.5 | 0.0 |
| Bone marrow | 0.0 | 6.9 | 2.5 | Ovarian ca. OVCAR-3 | 0.0 | 0.0 | 0.0 |
| Thymus | 0.0 | 1.9 | 0.9 | Ovarian ca. OVCAR-4 | 0.0 | 0.0 | 0.4 |
| Spleen | 0.0 | 4.2 | 1.0 | Ovarian ca. OVCAR-5 | 0.0 | 0.3 | 0.0 |
| Lymph node | 0.0 | 3.0 | 5.4 | Ovarian ca. OVCAR-8 | 0.0 | 0.0 | 0.0 |
| Colorectal | 0.0 | 0.5 | 0.0 | Ovarian ca. IGROV-1 | 0.0 | 0.0 | 0.0 |
| Stomach | 0.0 | 0.9 | 0.0 | Ovarian ca.* (ascites) SK-OV-3 | 0.0 | 0.0 | 0.0 |
| Small intestine | 0.0 | 1.5 | 0.5 | Uterus | 0.0 | 0.0 | 0.5 |
| Colon ca. SW480 | 0.0 | 0.8 | 0.0 | Placenta | 0.0 | 0.0 | 0.0 |

TABLE UC.-continued

Panel 1.3D

| Tissue Name | Rel. Exp.(%) Ag2950, Run 167907051 | Rel. Exp.(%) Ag2966, Run 160658385 | Rel. Exp.(%) Ag2966, Run 165701959 | Tissue Name | Rel. Exp.(%) Ag2950, Run 167907051 | Rel. Exp.(%) Ag2966, Run 160658385 | Rel. Exp.(%) Ag2966, Run 165701959 |
|---|---|---|---|---|---|---|---|
| Colon ca.* SW620(SW480 met) | 0.0 | 0.0 | 0.0 | Prostate | 0.0 | 0.0 | 0.0 |
| Colon ca. HT29 | 0.0 | 0.0 | 0.0 | Prostate ca.* (bone met)PC-3 | 0.0 | 0.0 | 0.0 |
| Colon ca. HCT-116 | 0.0 | 0.0 | 0.0 | Testis | 0.0 | 1.6 | 0.8 |
| Colon ca. CaCo-2 | 0.0 | 0.0 | 0.0 | Melanoma Hs688(A).T | 0.0 | 0.0 | 0.0 |
| Colon ca. tissue(ODO3866) | 0.0 | 0.3 | 0.3 | Melanoma* (met) Hs688(B).T | 0.0 | 0.0 | 0.0 |
| Colon ca. HCC-2998 | 0.0 | 0.3 | 0.0 | Melanoma UACC-62 | 0.0 | 0.0 | 0.0 |
| Gastric ca.* (liver met) NCI-N87 | 0.0 | 0.2 | 0.7 | Melanoma M14 | 0.0 | 0.0 | 0.0 |
| Bladder | 0.0 | 0.2 | 0.3 | Melanoma LOX IMVI | 0.0 | 0.0 | 0.0 |
| Trachea | 0.0 | 0.6 | 0.0 | Melanoma* (met) SK-MEL-5 | 0.0 | 0.0 | 0.0 |
| Kidney | 100.0 | 100.0 | 100.0 | Adipose | 0.0 | 0.1 | 0.6 |

TABLE UD

Panel 2D

| Tissue Name | Rel. Exp.(%) Ag2966, Run 160658389 | Tissue Name | Rel. Exp.(%) Ag2966, Run 160658389 | Tissue Name | Rel. Exp.(%) Ag2966, Run 160658389 | Tissue Name | Rel. Exp.(%) Ag2966, Run 160658389 |
|---|---|---|---|---|---|---|---|
| Normal Colon | 0.2 | Kidney Margin 8120608 | 91.4 | Prostate Margin (OD04410) | 0.0 | Breast Cancer Metastasis (OD04655-05) | 0.9 |
| CC Well to Mod Diff (ODO3866) | 0.1 | Kidney Cancer 8120613 | 0.1 | Prostate Cancer (OD04720-01) | 0.1 | Breast Cancer 064006 | 0.2 |
| CC Margin (ODO3866) | 0.3 | Kidney Margin 8120614 | 100.0 | Prostate Margin (OD04720-02) | 0.2 | Breast Cancer 1024 | 0.4 |
| CC Gr.2 rectosigmoid (ODO3868) | 0.3 | Kidney Cancer 9010320 | 0.4 | Normal Lung 061010 | 1.5 | Breast Cancer 9100266 | 0.1 |
| CC Margin (ODO3868) | 0.1 | Kidney Margin 9010321 | 66.9 | Lung Met to Muscle (ODO4286) | 0.2 | Breast Margin 9100265 | 0.0 |
| CC Mod Diff (ODO3920) | 0.6 | Normal Uterus | 0.2 | Muscle Margin (ODO4286) | 0.0 | Breast Cancer A209073 | 0.2 |
| CC Margin (ODO3920) | 0.4 | Uterus Cancer 064011 | 0.4 | Lung Malignant Cancer (OD03126) | 0.2 | Breast Margin A2090734 | 0.3 |
| CC Gr.2 ascend colon (ODO3921) | 0.4 | Normal Thyroid | 0.1 | Lung Margin (OD03126) | 0.4 | Normal Liver | 0.1 |
| CC Margin (ODO3921) | 0.3 | Thyroid Cancer 064010 | 0.0 | Lung Cancer (OD04404) | 0.4 | Liver Cancer 064003 | 0.1 |
| CC from Partial Hepatectomy (ODO4309) Mets | 0.4 | Thyroid Cancer A302152 | 0.0 | Lung Margin (OD04404) | 0.4 | Liver Cancer 1025 | 0.2 |
| Liver Margin (ODO4309 | 0.2 | Thyroid Margin A302153 | 0.5 | Lung Cancer (OD04565) | 0.2 | Liver Cancer 1026 | 0.0 |
| Colon mets to lung (OD04451-01) | 0.5 | Normal Breast | 0.8 | Lung Margin (OD04565) | 0.4 | Liver Cancer 6004-T | 0.1 |
| Lung Margin (OD04451-02) | 0.1 | Breast Cancer (OD04566) | 0.3 | Lung Cancer (OD04237-01) | 0.1 | Liver Tissue 6004-N | 0.1 |
| Normal Prostate 6546-1 | 0.0 | Breast Cancer (OD04590-01) | 0.8 | Lung Margin (OD04237-02) | 0.0 | Liver Cancer 6005-T | 0.0 |
| Prostate Cancer (OD04410) | 0.2 | Breast Cancer Mets (OD04590-03) | 0.8 | Ocular Mel Met to Liver (ODO4310) | 1.8 | Liver Tissue 6005-N | 0.0 |
| | | | | Liver Margin (ODO4310) | 0.0 | Normal Bladder | 0.2 |

TABLE UD-continued

Panel 2D

| Tissue Name | Rel. Exp.(%) Ag2966, Run 160658389 | Tissue Name | Rel. Exp.(%) Ag2966, Run 160658389 |
|---|---|---|---|
| Melanoma Mets to Lung (ODO4321) | 0.1 | Bladder Cancer 1023 | 0.1 |
| Lung Margin (OD04321) | 0.4 | Bladder Cancer A302173 | 0.1 |
| Normal Kidney | 29.9 | Bladder Cancer (OD04718-01) | 0.1 |
| Kidney Ca, Nuclear grade (OD04338) | 9.4 | Bladder Normal Adjacent (OD04718-03) | 0.1 |
| Kidney Margin (OD04338) | 26.2 | Normal Ovary | 0.0 |
| Kidney Ca Nuclear grade 1/2 (OD04339) | 1.3 | Ovarian Cancer 064008 | 0.1 |
| Kidney Margin (OD04339) | 75.8 | Ovarian Cancer (OD04768-07) | 0.0 |
| Kidney Ca, Clear cell type (OD04340) | 29.5 | Ovary Margin (OD04768-08) | 0.0 |
| Kidney Margin (OD04340) | 27.5 | Normal Stomach | 0.1 |
| Kidney Ca, Nuclear grade 3 (OD04348) | 0.7 | Gastric Cancer 9060358 | 0.1 |
| Kidney Margin (OD04348) | 11.4 | Stomach Margin 9060359 | 0.1 |
| Kidney Cancer (OD04622-01) | 0.9 | Gastric Cancer 9060395 | 0.1 |
| Kidney Margin (OD04622-03) | 9.6 | Stomach Margin 9060394 | 0.1 |
| Kidney Cancer (OD04450-01) | 0.8 | Gastric Cancer 9060397 | 0.1 |
| Kidney Margin (OD04450-03) | 8.2 | Stomach Margin 9060396 | 0.0 |
| Kidney Cancer 8120607 | 0.6 | Gastric Cancer 064005 | 0.3 |

TABLE UE

Panel 3D

| Tissue Name | Rel. Exp.(%) Ag2966, Run 164886340 | Tissue Name | Rel. Exp.(%) Ag2966, Run 164886340 |
|---|---|---|---|
| Daoy-Medulloblastoma | 0.0 | Ca Ski-Cervical epidermoid carcinoma (metastasis) | 0.0 |
| TE671- Medulloblastoma | 0.0 | ES-2-Ovarian clear cell carcinoma | 0.0 |
| D283 Med-Medulloblastoma | 0.0 | Ramos-Stimulated with PMA/ionomycin 6h | 0.1 |
| PFSK-1-Primitive Neuroectodermal | 0.2 | Ramos-Stimulated with PMA/ionomycin 14h | 0.3 |
| XF-498-CNS | 0.0 | MEG-01-Chronic myelogenous leukemia (megokaryoblast) | 0.0 |
| SNB-78-Glioma | 0.0 | Raji-Burkitt's lymphoma | 0.5 |
| SF-268-Glioblastoma | 0.0 | Daudi-Burkitt's lymphoma | 1.7 |
| T98G-Glioblastoma | 0.1 | U266-B-cell plasmacytoma | 0.0 |
| SK-N-SH-Neuroblastoma (metastasis) | 0.0 | CA46-Burkitt's lymphoma | 0.1 |
| SF-295-Glioblastoma | 0.0 | RL-non-Hodgkin's B-cell lymphoma | 0.0 |
| Cerebellum | 0.0 | JM1-pre-B-cell lymphoma | 0.4 |
| Cerebellum | 0.1 | Jurkat-T cell leukemia | 0.1 |
| NCI-H292-Mucoepidermoid lung carcinoma | 0.0 | TF-1-Erythroleukemia | 0.1 |
| DMS-114-Small cell lung cancer | 0.0 | HUT 78-T-cell lymphoma | 0.1 |
| DMS-79-Small cell lung cancer | 0.0 | U937-Histiocytic lymphoma | 0.1 |
| NCI-H146-Small cell lung cancer | 0.0 | KU-812-Myelogenous leukemia | 0.0 |
| NCI-H526-Small cell lung cancer | 0.0 | 769-P-Clear cell renal carcinoma | 0.0 |
| NCI-N417-Small cell lung cancer | 0.0 | Caki-2-Clear cell renal carcinoma | 0.0 |
| NCI-H82-Small cell lung cancer | 0.0 | SW 839-Clear cell renal carcinoma | 0.2 |

TABLE UE-continued

Panel 3D

| Tissue Name | Rel. Exp.(%) Ag2966, Run 164886340 | Tissue Name | Rel. Exp.(%) Ag2966, Run 164886340 |
|---|---|---|---|
| NCI-H157-Squamous cell lung cancer (metastasis) | 0.0 | G401-Wilms' tumor | 0.0 |
| NCI-H1155-Large cell lung cancer | 0.0 | Hs766T-Pancreatic carcinoma (LN metastasis) | 0.0 |
| NCI-H1299-Large cell lung cancer | 0.0 | CAPAN-1-Pancreatic adenocarcinoma (liver metastasis) | 0.0 |
| NCI-H727-Lung carcinoid | 0.1 | SU86.86-Pancreatic carcinoma (liver metastasis) | 0.1 |
| NCI-UMC-11-Lung carcinoid | 0.0 | BxPC-3-Pancreatic adenocarcinoma | 0.2 |
| LX-1-Small cell lung cancer | 0.1 | HPAC-Pancreatic adenocarcinoma | 0.0 |
| Colo-205-Colon cancer | 100.0 | MIA PaCa-2-Pancreatic carcinoma | 0.0 |
| KM12-Colon cancer | 0.0 | CFPAC-1-Pancreatic ductal adenocarcinoma | 0.1 |
| KM20L2-Colon cancer | 0.0 | PANC-1-Pancreatic epithelioid ductal carcinoma | 0.0 |
| NCI-H716-Colon cancer | 0.0 | T24-Bladder carcinma (transitional cell) | 0.0 |
| SW-48-Colon adenocarcinoma | 0.0 | 5637-Bladder carcinoma | 0.0 |
| SW1116-Colon adenocarcinoma | 0.0 | HT-1197-Bladder carcinoma | 0.0 |
| LS 174T-Colon adenocarcinoma | 0.0 | UM-UC-3-Bladder carcinma (transitional cell) | 0.0 |
| SW-948-Colon adenocarcinoma | 0.0 | A204-Rhabdomyosarcoma | 0.0 |
| SW-480-Colon adenocarcinoma | 0.1 | HT-1080-Fibrosarcoma | 0.0 |
| NCI-SNU-5-Gastric carcinoma | 0.0 | MG-63-Osteosarcoma | 0.0 |
| KATO III-Gastric carcinoma | 0.3 | SK-LMS-1-Leiomyosarcoma (vulva) | 0.0 |
| NCI-SNU-16-Gastric carcinoma | 0.1 | SJRH30-Rhabdomyosarcoma (met to bone marrow) | 0.0 |
| NCI-SNU-1-Gastric carcinoma | 0.0 | A431-Epidermoid carcinoma | 0.0 |
| RF-1-Gastric adenocarcinoma | 0.3 | WM266-4-Melanoma | 0.0 |
| RF-48-Gastric adenocarcinoma | 0.1 | DU 145-Prostate carcinoma (brain metastasis) | 0.0 |
| MKN-45-Gastric carcinoma | 0.0 | MDA-MB-468-Breast adenocarcinoma | 0.0 |
| NCI-N87-Gastric carcinoma | 0.0 | SCC-4-Squamous cell carcinoma of tongue | 0.0 |
| OVCAR-5-Ovarian carcinoma | 0.0 | SCC-9-Squamous cell carcinoma of tongue | 0.0 |
| RL95-2-Uterine carcinoma | 0.1 | SCC-15-Squamous cell carcinoma of tongue | 0.0 |
| HelaS3-Cervical adenocarcinoma | 0.2 | CAL 27-Squamous cell carcinoma of tongue | 0.0 |

TABLE UF

Panel 4D

| Tissue Name | Rel. Exp.(%) Ag2950, Run 164306341 | Rel. Exp.(%) Ag2966, Run 160660646 | Tissue Name | Rel. Exp.(%) Ag2950, Run 164306341 | Rel. Exp.(%) Ag2966, Run 160660646 |
|---|---|---|---|---|---|
| Secondary Th1 act | 0.0 | 0.0 | HUVEC IL-1beta | 0.0 | 0.3 |
| Secondary Th2 act | 0.0 | 0.0 | HUVEC IFN gamma | 0.0 | 0.9 |
| Secondary Tr1 act | 0.0 | 0.7 | HUVEC TNF alpha + IFN gamma | 0.0 | 0.3 |

TABLE UF-continued

Panel 4D

| Tissue Name | Rel. Exp.(%) Ag2950, Run 164306341 | Rel. Exp.(%) Ag2966, Run 160660646 | Tissue Name | Rel. Exp.(%) Ag2950, Run 164306341 | Rel. Exp.(%) Ag2966, Run 160660646 |
|---|---|---|---|---|---|
| Secondary Th1 rest | 0.0 | 0.2 | HUVEC TNF alpha + IFN | 0.0 | 0.5 |
| Secondary Th2 rest | 0.0 | 1.6 | HUVEC IL-11 | 0.0 | 0.8 |
| Secondary Tr1 rest | 0.0 | 1.5 | Lung Microvascular EC none | 0.0 | 2.0 |
| Primary Th1 act | 0.0 | 0.3 | Lung Microvascular EC TNFalpha + IL-1beta | 0.0 | 0.8 |
| Primary Th2 act | 0.0 | 0.0 | Microvascular Dermal EC none | 0.0 | 1.9 |
| Primary Tr1 act | 0.0 | 0.3 | Microsvasular Dermal EC TNFalpha + IL-1beta | 0.0 | 1.7 |
| Primary Th1 rest | 0.0 | 4.8 | Bronchial epithelium TNFalpha + IL1beta | 0.0 | 0.0 |
| Primary Th2 rest | 0.0 | 2.1 | Small airway epithelium none | 0.0 | 0.0 |
| Primary Tr1 rest | 0.0 | 3.4 | Small airway epithelium TNFalpha + IL-1beta | 0.0 | 0.3 |
| CD45RA CD4 lymphocyte act | 0.0 | 0.6 | Coronery artery SMC rest | 0.0 | 0.0 |
| CD45RO CD4 lymphocyte act | 0.0 | 1.1 | Coronery artery SMC TNFalpha + IL-1beta | 0.0 | 0.3 |
| CD8 lymphocyte act | 0.0 | 0.3 | Astrocytes rest | 0.0 | 0.0 |
| Secondary CD8 lymphocyte rest | 0.0 | 1.3 | Astrocytes TNFalpha + IL-1beta | 0.0 | 0.3 |
| Secondary CD8 lymphocyte act | 0.0 | 0.0 | KU-812 (Basophil) rest | 0.0 | 0.3 |
| CD4 lymphocyte none | 0.0 | 1.7 | KU-812 (Basophil) PMA/ionomycin | 0.0 | 0.0 |
| 2ry Th1/Th2/Tr1_anti-CD95 CH11 | 0.0 | 0.8 | CCD1106 (Keratinocytes) none | 0.0 | 0.1 |
| LAK cells rest | 0.0 | 2.1 | CCD1106 (Keratinocytes) TNFalpha + IL-1beta | 0.0 | 0.0 |
| LAK cells IL-2 | 0.0 | 0.4 | Liver cirrhosis | 0.0 | 0.4 |
| LAK cells IL-2 + IL-12 | 0.0 | 0.3 | Lupus kidney | 0.0 | 1.0 |
| LAK cells IL-2 + IFN gamma | 0.0 | 0.6 | NCI-H292 none | 0.0 | 0.6 |
| LAK cells IL-2 + IL-18 | 0.0 | 0.6 | NCI-H292 IL-4 | 0.0 | 0.0 |
| LAK cells PMA/ionomycin | 0.0 | 0.0 | NCI-H292 IL-9 | 0.0 | 0.0 |
| NK Cells IL-2 rest | 0.0 | 0.6 | NCI-H292 IL-13 | 0.0 | 0.0 |
| Two Way MLR 3 day | 0.0 | 1.1 | NCI-H292 IFN gamma | 0.0 | 0.0 |
| Two Way MLR 5 day | 0.0 | 1.0 | HPAEC none | 0.0 | 0.6 |
| Two Way MLR 7 day | 0.0 | 0.5 | HPAEC TNF alpha + IL-1 beta | 0.0 | 0.0 |
| PBMC rest | 0.0 | 0.6 | Lung fibroblast none | 0.0 | 0.0 |
| PBMC PWM | 0.0 | 1.1 | Lung fibroblast TNF alpha + IL-1 beta | 0.0 | 0.0 |
| PBMC PHA-L | 0.0 | 0.2 | Lung fibroblast IL-4 | 0.0 | 0.0 |

TABLE UF-continued

Panel 4D

| Tissue Name | Rel. Exp.(%) Ag2950, Run 164306341 | Rel. Exp.(%) Ag2966, Run 160660646 | Tissue Name | Rel. Exp.(%) Ag2950, Run 164306341 | Rel. Exp.(%) Ag2966, Run 160660646 |
|---|---|---|---|---|---|
| Ramos (B cell) | 0.0 | 1.7 | Lung fibroblast IL-9 | 0.0 | 0.0 |
| Ramos (B cell) ionomycin | 0.0 | 1.1 | Lung fibroblast IL-13 | 0.0 | 0.0 |
| B lymphocytes PWM | 0.0 | 1.4 | Lung fibroblast IFN gamma | 0.0 | 0.2 |
| B lymphocytes CD40L and IL-4 | 0.0 | 4.7 | Dermal fibroblast CCD1070 rest | 0.0 | 0.0 |
| EOL-1 dbcAMP | 0.0 | 0.0 | Dermal fibroblast CCD1070 TNF alpha | 0.0 | 1.4 |
| EOL-1 dbcAMP PMA/ionomycin | 0.0 | 0.1 | Dermal fibroblast CCD1070 IL-1 beta | 0.0 | 0.0 |
| Dendritic cells none | 0.0 | 0.5 | Dermal fibroblast IFN gamma | 0.0 | 0.0 |
| Dendritic cells LPS | 0.0 | 0.0 | Dermal fibroblast IL-4 | 0.0 | 0.0 |
| Dendritic cells anti-CD40 | 0.0 | 0.5 | IBD Colitis 2 | 0.0 | 0.2 |
| Monocytes rest | 0.0 | 1.2 | IBD Crohn's | 0.0 | 0.0 |
| Monocytes LPS | 0.0 | 0.0 | Colon | 0.0 | 4.9 |
| Macrophages rest | 0.0 | 0.2 | Lung | 0.0 | 3.1 |
| Macrophages LPS | 0.0 | 0.0 | Thymus | 100.0 | 100.0 |
| HUVEC none | 0.0 | 0.5 | Kidney | 0.0 | 4.6 |
| HUVEC starved | 0.0 | 0.3 | | | |

Panel 1.3D Summary: Ag2950/Ag2966 Three experiments both show expression of the CG56559-01 gene, a sodium-glucose cotransporter homolog, limited to the kidney (CTs=29). This restricted expression is in agreement with published data that shows secondary active transport of glucose in the kidney is mediated by sodium glucose cotransporter. (See ref. 1). Thus, expression of this gene could be used as a marker for kidney tissue. Furthermore, the protein product may be important for normal function of the kidney. Thus, therapeutic modulation of the expression or function of this protein may be useful in treating diseases that affect the kidney, including diabetes.

REFERENCES

Bissonnette P, Noel J, Coady M J, Lapointe J Y. Functional expression of tagged human Na+-glucose cotransporter in *Xenopus laevis* oocytes. J Physiol 1999 Oct. 15; 520 Pt 2:359–71

1. High-affinity, secondary active transport of glucose in the intestine and kidney is mediated by an integral membrane protein named SGLT1 (sodium glucose cotransporter). Though basic properties of the transporter are now defined, many questions regarding the structure—function relationship of the protein, its biosynthesis and targeting remain unanswered. In order to better address these questions, we produced a functional hSGLT1 protein (from human) containing a reporter tag. 2. Six constructs, made from three tags (myc, haemaglutinin and poly-His) inserted at both the C- and N-terminal positions, were thus tested using the *Xenopus* oocyte expression system via electrophysiology and immunohistochemistry. Of these, only the hSGLT1 construct with the myc tag inserted at the N-terminal position proved to be of interest, all other constructs showing no or little transport activity. A systematic comparison of transport properties was therefore performed between the myc-tagged and the untagged hSGLT1 proteins. 3. On the basis of both steady-state (affinities for substrate (glucose) and inhibitor (phlorizin) as well as expression levels) and presteady-state parameters (transient currents) we conclude that the two proteins are functionally indistinguishable, at least under these criteria. Immunological detection confirmed the appropriate targeting of the tagged protein to the plasma membrane of the oocyte with the epitope located at the extracellular side. 4. The myc-tagged hSGLT1 was also successfully expressed in polarized MDCK cells. alpha-Methylglucose uptake studies on transfected cells showed an exclusively apical uptake pathway, thus indicating that the expressed protein was correctly targeted to the apical domain of the cell. 5. These comparative studies demonstrate that the myc epitope inserted at the N-terminus of hSGLT1 produces a fully functional protein while other epitopes of similar size inserted at either end of the protein inactivated the final protein.

PMID: 10523405

Panel 2D Summary: Ag2966 Expression of the CG56559-01 gene is predominantly limited to the kidney. This result is in agreement with the expression seen in Panel 1.3D. Thus, expression of this gene might be used as a marker of normal kidney tissue.

Panel 3D Summary: Ag2966 Results from one experiment with the CG56559-01 gene are not included. The amp plot indicates that there were experimental difficulties with this run.

Panel 4D Summary: Ag2950/Ag2966 Expression of the CG56559-01 gene is predominantly found in normal tissue from thymus, lung, colon and kidney. This expression profile suggests that the protein product may be involved in glucose transport and normal homeostasis in these tissues. Therefore, therapeutic modulation of the expression or function of this protein may be useful in for maintaining or restoring normal function to these organs during inflammation.

NOV29a: CG56557-01: Na(+)/Glucose Cotransporter

Expression of gene CG56557-01 was assessed using the primer-probe set Ag2931, described in Table VA. Results of the RTQ-PCR runs are shown in Table VB.

TABLE VA

Probe Name Ag2931

| Primers | Sequences | Length | Start Position |
|---|---|---|---|
| Forward | 5'-cagaggatccaggtgtacatgt-3' (SEQ ID NO: 464) | 22 | 501 |
| Probe | TET-5'-tcctctacatcttcaccaagatctcgg-3'-TAMRA (SEQ ID NO: 465) | 27 | 538 |
| Reverse | 5'-agggctccagagaagatgtcta-3' (SEQ ID NO: 466) | 22 | 565 |

TABLE VB

Panel 4D

| Tissue Name | Rel. Exp. (%) Ag2931, Run 165871866 | Tissue Name | Rel. Exp. (%) Ag2931, Run 165871866 |
|---|---|---|---|
| Secondary Th1 act | 0.0 | HUVEC IL-1beta | 0.0 |
| Secondary Th2 act | 0.0 | HUVEC IFN gamma | 0.0 |
| Secondary Tr1 act | 0.0 | HUVEC TNF alpha + IFN gamma | 0.7 |
| Secondary Th1 rest | 0.0 | HUVEC TNF alpha + IL4 | 0.0 |
| Secondary Th2 rest | 0.0 | HUVEC IL-11 | 6.0 |
| Secondary Tr1 rest | 0.0 | Lung Microvascular EC none | 0.7 |
| Primary Th1 act | 0.0 | Lung Microvascular EC TNFalpha + IL-1beta | 23.0 |
| Primary Th2 act | 0.0 | Microvascular Dermal EC none | 0.0 |
| Primary Tr1 act | 0.0 | Microvascular Dermal EC TNFalpha + IL-1beta | 12.4 |
| Primary Th1 rest | 0.0 | Bronchial epithelium TNFalpha + IL1beta | 30.1 |
| Primary Th2 rest | 0.0 | Small airway epithelium none | 5.7 |
| Primary Tr1 rest | 0.0 | Small airway epithelium TNFalpha + IL-1beta | 100.0 |
| CD45RA CD4 lymphocyte act | 0.5 | Coronery artery SMC rest | 0.0 |
| CD45RO CD4 lymphocyte act | 0.0 | Coronery artery SMC TNFalpha + IL-1beta | 0.0 |
| CD8 lymphocyte act | 0.0 | Astrocytes rest | 0.0 |
| Secondary CD8 lymphocyte rest | 0.0 | Astrocytes TNFalpha + IL-1beta | 2.0 |
| Secondary CD8 lymphocyte act | 0.0 | KU-812 (Basophil) rest | 0.0 |
| CD4 lymphocyte none | 0.0 | KU-812 (Basophil) PMA/ionomycin | 0.0 |
| 2ry Th1/Th2/Tr1_anti-CD95 CH11 | 0.0 | CCD1106 (Keratinocytes) none | 0.0 |
| LAK cells rest | 0.0 | CCD1106 (Keratinocytes) TNFalpha + IL-1beta | 46.3 |
| LAK cells IL-2 | 0.0 | Liver cirrhosis | 90.1 |
| LAK cells IL-2 + IL-12 | 0.0 | Lupus kidney | 0.0 |
| LAK cells IL-2 + IFN gamma | 0.0 | NCI-H292 none | 0.0 |
| LAK cells IL-2+ IL-18 | 0.0 | NCI-H292 IL-4 | 0.0 |
| LAK cells PMA/ionomycin | 0.0 | NCI-H292 IL-9 | 0.0 |
| NK Cells IL-2 rest | 0.0 | NCI-H292 IL-13 | 0.0 |
| Two Way MLR 3 day | 0.0 | NCI-H292 IFN gamma | 0.0 |
| Two Way MLR 5 day | 0.0 | HPAEC none | 0.0 |
| Two Way MLR 7 day | 0.0 | HPAEC TNF alpha + IL-1 beta | 0.6 |
| PBMC rest | 0.0 | Lung fibroblast none | 0.0 |

TABLE VB-continued

Panel 4D

| Tissue Name | Rel. Exp. (%) Ag2931, Run 165871866 | Tissue Name | Rel. Exp. (%) Ag2931, Run 165871866 |
|---|---|---|---|
| PBMC PWM | 0.0 | Lung fibroblast TNF alpha + IL-1 beta | 6.3 |
| PBMC PHA-L | 0.0 | Lung fibroblast IL-4 | 0.0 |
| Ramos (B cell) none | 0.0 | Lung fibroblast IL-9 | 0.0 |
| Ramos (B cell) ionomycin | 0.0 | Lung fibroblast IL-13 | 0.0 |
| B lymphocytes PWM | 0.0 | Lung fibroblast IFN gamma | 0.0 |
| B lymphocytes CD40L and IL-4 | 0.0 | Dermal fibroblast CCD1070 rest | 0.0 |
| EOL-1 dbcAMP | 0.0 | Dermal fibroblast CCD1070 TNF alpha | 2.7 |
| EOL-1 dbcAMP PMA/ionomycin | 0.0 | Dermal fibroblast CCD1070 IL-1 beta | 0.4 |
| Dendritic cells none | 0.0 | Dermal fibroblast IFN gamma | 0.0 |
| Dendritic cells LPS | 0.0 | Dermal fibroblast IL-4 | 0.0 |
| Dendritic cells anti-CD40 | 0.0 | IBD Colitis 2 | 2.8 |
| Monocytes rest | 0.0 | IBD Crohn's | 0.0 |
| Monocytes LPS | 0.0 | Colon | 13.8 |
| Macrophages rest | 0.0 | Lung | 0.0 |
| Macrophages LPS | 0.0 | Thymus | 0.0 |
| HUVEC none | 0.0 | Kidney | 0.0 |
| HUVEC starved | 0.0 | | |

CNS_neurodegeneration_v1.0 Summary: Ag2931 Data from one experiment with this probe and primer set and the CG56557-01 gene show low/undetectable levels of expression in all samples on this panel. (CTs>35). (Data not shown.) The amp plot indicates that there is a high probability of a probe failure in this experiment.

Panel 1.3D Summary: Ag2931 Data from one experiment with this probe and primer set and the CG56557-01 gene show low/undetectable levels of expression in all samples on this panel. (CTs>35). (Data not shown.) The amp plot indicates that there is a high probability of a probe failure in this experiment.

Panel 2D Summary: Ag2931 Data from one experiment with this probe and primer set and the CG56557-01 gene show low/undetectable levels of expression in all samples on this panel. (CTs>35). (Data not shown.) The amp plot indicates that there is a high probability of a probe failure in this experiment.

Panel 4D Summary: Ag2931 This CG56557-01 transcript, a Na/glucose cotransporter homolog, is expressed at low levels in small airway epithelium, bronchial epithelium, keratinocytes and lung microvasculature. Furthermore, expression of this transcript is upregulated by the proinflammatory cytokines TNF-a and IL-1b in all these samples. Modulation of the expression and/or activity of this putative protein by antibodies or small molecules may reduce or eliminate inflammatory reactions that occurs in the lung or skin as a result of asthyma, COPD, emphysema, psoriasis or other skin inflammatory diseases. Ag2931 Data from one experiment on this panel with the CG56557-01 gene, designated Run 164300130, is not included. The amp plot indicates that there were experimental difficulties with this run.

NOV29d and NOV29f: CG56557-04 and CG56557-06: Na(+)/Glucose Cotransporter

Expression of gene CG56557-04 and variant CG56557-06 was assessed using the primer-probe set Ag6054, described in Table WA. Please note that CG56557-04 is a splice variant of CG56557-01 (presented in section V above)

TABLE WA

Probe Name Ag6054

| Primers | Sequences | Length | Start Position |
|---|---|---|---|
| Forward | 5'-tcgtccatccgtgcaa-3' (SEQ ID NO:467) | 16 | 160 |
| Probe | TET-5'-cgagggaccattggcggcta-3'-TAMPA (SEQ ID NO: 468) | 20 | 178 |
| Reverse | 5'-gggtggggccagga-3' (SEQ ID NO: 469) | 14 | 200 |

CNS_neurodegeneration_v1.0 Summary: Ag6054 Expression of the CG56557-06 gene is low/undetectable in all samples on this panel (CTs>35).

General_screening_panel_v1.5 Summary: Ag6054 Expression of the CG56557-06 gene is low/undetectable in all samples on this panel (CTs>35).

Panel 4.1D Summary: Ag6054 Expression of the CG56557-06 gene is low/undetectable in all samples on this panel (CTs>35).

NOV29c: CG56557-03: Splice Variant of CG56557-01

Expression of gene CG56557-03 was assessed using the primer-probe set Ag6053, described in Table XA. Results of the RTQ-PCR runs are shown in Tables XB and XC.

TABLE XA

Probe Name Ag6053

| Primers | Sequences | Length | Start Position |
|---|---|---|---|
| Forward | 5'-caggtctcttatttctctgttcg-3' (SEQ ID NO:470) | 23 | 410 |
| Probe | TET-5'-cctcccacagcacagcactgc-3'-TAMRA (SEQ ID NO: 471) | 21 | 437 |
| Reverse | 5'-acagagggcggctt-3' (SEQ ID NO: 472) | 15 | 469 |

TABLE XB

General_screening_panel v1.5

| Tissue Name | Rel. Exp. (%) Ag6053, Run 228745661 | Tissue Name | Rel. Exp. (%) Ag6053, Run 228745661 |
|---|---|---|---|
| Adipose | 1.2 | Renal ca. TK-10 | 37.9 |
| Melanoma* Hs688(A).T | 0.2 | Bladder | 23.5 |
| Melanoma* Hs688(B).T | 0.1 | Gastric ca. (liver met.) NCI-N87 | 16.8 |
| Melanoma* M14 | 0.7 | Gastric ca. KATO III | 0.2 |
| Melanoma* LOXIMVI | 0.0 | Colon ca. SW-948 | 0.2 |
| Melanoma* SK-MEL-5 | 0.0 | Colon ca. SW480 | 0.0 |
| Squamous cell carcinoma SCC-4 | 0.0 | Colon ca.* (SW480 met) SW620 | 0.3 |
| Testis Pool | 1.7 | Colon ca. HT29 | 5.1 |
| Prostate ca.* (bone met) PC-3 | 0.4 | Colon ca. HCT-116 | 2.3 |
| Prostate Pool | 5.4 | Colon ca. CaCo-2 | 100.0 |
| Placenta | 0.7 | Colon cancer tissue | 5.8 |
| Uterus Pool | 6.0 | Colon ca. SW1116 | 0.0 |
| Ovarian ca. OVCAR-3 | 0.9 | Colon ca. Colo-205 | 0.5 |
| Ovarian ca. SK-OV-3 | 3.8 | Colon ca. SW-48 | 2.1 |
| Ovarian ca. OVCAR-4 | 0.0 | Colon Pool | 4.2 |
| Ovarian ca. OVCAR-5 | 10.7 | Small Intestine Pool | 5.7 |
| Ovarian ca. IGROV-1 | 4.2 | Stomach Pool | 3.3 |
| Ovarian Ca. OVCAR-8 | 2.5 | Bone Marrow Pool | 2.5 |
| Ovary | 6.2 | Fetal Heart | 2.9 |
| Breast ca. MCF-7 | 0.0 | Heart Pool | 2.8 |
| Breast ca. MDA-MB-231 | 0.0 | Lymph Node Pool | 6.7 |
| Breast ca. BT 549 | 0.7 | Fetal Skeletal Muscle | 3.6 |
| Breast ca. T47D | 0.0 | Skeletal Muscle Pool | 1.9 |
| Breast ca. MDA-N | 1.4 | Spleen Pool | 7.9 |
| Breast Pool | 5.0 | Thymus Pool | 4.3 |
| Trachea | 4.2 | CNS cancer (glio/astro) U87-MG | 2.5 |
| Lung | 2.1 | CNS cancer (glio/astro) U-118-MG | 1.2 |
| Fetal Lung | 51.4 | CNS cancer (neuro; met) SK-N-AS | 3.9 |
| Lung ca. NCI-N417 | 0.0 | CNS cancer (astro) SF-539 | 0.0 |
| Lung ca. LX-1 | 0.3 | CNS cancer (astro) SNB-75 | 3.8 |
| Lung ca. NCI-H146 | 0.0 | CNS cancer (glio) SNB-19 | 4.4 |
| Lung ca. SHP-77 | 2.0 | CNS cancer (glio) SF-295 | 6.9 |
| Lung ca. A549 | 2.8 | Brain (Amygdala) Pool | 1.0 |
| Lung ca. NCI:H526 | 0.0 | Brain (cerebellum) | 1.6 |
| Lung ca. NCI-H23 | 4.5 | Brain (fetal) | 0.0 |
| Lung ca. NCI-H460 | 11.2 | Brain (Hippocampus) Pool | 1.7 |
| Lung ca. HOP-62 | 0.5 | Cerebral Cortex Pool | 1.5 |
| Lung ca. NCI-H522 | 3.0 | Brain (Substantia nigra) Pool | 1.0 |
| Liver | 1.3 | Brain (Thalmus) Pool | 1.0 |
| Fetal Liver | 61.6 | Brain (whole) | 1.3 |
| Liver ca. HepG2 | 63.7 | Spinal Cord Pool | 2.5 |
| Kidney Pool | 16.2 | Adrenal Gland | 3.5 |
| Fetal Kidney | 40.3 | Pituitary gland Pool | 1.9 |
| Renal ca. 786-0 | 4.8 | Salivary Gland | 1.9 |
| Renal ca. A498 | 1.3 | Thyroid (female) | 0.5 |
| Renal ca. ACHN | 0.2 | Pancreatic ca. CAPAN2 | 0.4 |
| Renal ca. UO-31 | 0.3 | Pancreas Pool | 12.4 |

TABLE XC

Panel 4.1D

| Tissue Name | Rel. Exp. (%) Ag6053, Run 226202129 | Tissue Name | Rel. Exp. (%) Ag6053, Run 226202129 |
|---|---|---|---|
| Secondary Th1 act | 0.0 | HUVEC IL:1beta | 0.1 |
| Secondary Th2 act | 0.0 | HUVEC IFN gamma | 0.0 |
| Secondary Tr1 act | 0.0 | HUVEC TNF alpha + IFN gamma | 0.0 |
| Secondary Th1 rest | 0.0 | HUVEC TNF alpha + IL4 | 0.0 |
| Secondary Th2 rest | 0.0 | HUVEC IL-11 | 0.0 |
| Secondary Tr1 rest | 0.0 | Lung Microvascular EC none | 1.0 |
| Primary Th1 act | 0.0 | Lung Microvascular EC TNFalpha + IL-1beta | 1.0 |
| Primary Th2 act | 0.0 | Microvascular Dermal EC none | 0.0 |
| Primary Tr1 act | 0.0 | Microvascular Dermal EC TNFalpha + IL-1beta | 0.0 |
| Primary Th1 rest | 0.0 | Bronchial epithelium TNFalpha + IL1beta | 0.6 |
| Primary Th2 rest | 0.0 | Small airway epithelium none | 0.7 |
| Primary Tr1 rest | 0.0 | Small airway epithelium TNFalpha + IL-1beta | 0.0 |
| CD45RA CD4 lymphocyte act | 0.0 | Coronery artery SMC rest | 0.0 |
| CD45RO CD4 lymphocyte act | 0.9 | Coronery artery SMC TNFalpha + IL-1beta | 0.0 |
| CD8 lymphocyte act | 0.0 | Astrocytes rest | 1.0 |
| Secondary CD8 lymphocyte rest | 0.0 | Astrocytes TNFalpha + IL-1beta | 0.5 |
| Secondary CD8 lymphocyte act | 0.0 | KU-812 (Basophil) rest | 0.0 |
| CD4 lymphocyte none | 0.0 | KU-812 (Basophil) PMA/ionomycin | 0.0 |
| 2ry Th1/Th2/Tr1_anti-CD95 CH11 | 0.0 | CCD1106 (Keratinocytes) none | 0.0 |
| LAK cells rest | 0.5 | CCD1106 (Keratinocytes) TNFalpha + IL-1beta | 0.0 |
| LAK cells IL-2 | 0.5 | Liver cirrhosis | 5.5 |
| LAK cells IL-2 + IL-12 | 0.0 | NCI-H292 none | 0.0 |
| LAK cells IL-2 + IFN gamma | 0.5 | NCI-H292 IL-4 | 0.0 |
| LAK cells IL-2 + IL-18 | 0.5 | NCI-H292 IL-9 | 0.0 |
| LAK cells PMA/ionomycin | 0.0 | NCI-H292 IL-13 | 0.0 |
| NK Cells IL-2 rest | 0.3 | NCI-H292 IFN gamma | 0.0 |
| Two Way MLR 3 day | 0.4 | HPAEC none | 0.5 |
| Two Way MLR 5 day | 0.5 | HPAEC TNF alpha + IL-1 beta | 0.0 |
| Two Way MLR 7 day | 0.0 | Lung fibroblast none | 2.0 |
| PBMC rest | 1.5 | Lung fibroblast TNF alpha + IL-1 beta | 0.4 |
| PBMC PWM | 0.0 | Lung fibroblast IL-4 | 1.6 |
| PBMC PHA-L | 0.0 | Lung fibroblast IL-9 | 0.0 |
| Ramos (B cell) none | 0.0 | Lung fibroblast IL-13 | 1.1 |
| Ramos (B cell) ionomycin | 0.0 | Lung fibroblast IFN gamma | 0.0 |
| B lymphocytes PWM | 0.0 | Dermal fibroblast CCD1070 rest | 0.5 |
| B lymphocytes CD40L and IL-4 | 0.0 | Dermal fibroblast CCD1070 TNF alpha | 0.5 |
| EOL-1 dbcAMP | 0.0 | Dermal fibroblast CCD1070 IL-1beta | 0.0 |
| EOL-1 dbcAMP PMA/ionomycin | 0.0 | Dermal fibroblast IFN gamma | 0.4 |
| Dendritic cells none | 0.0 | Dermal fibroblast IL-4 | 1.1 |
| Dendritic cells LPS | 0.0 | Dermal Fibroblasts rest | 0.5 |
| Dendritic cells anti-CD40 | 1.3 | Neutrophils TNFa + LPS | 0.8 |
| Monocytes rest | 2.8 | Neutrophils rest | 0.8 |
| Monocytes LPS | 1.2 | Colon | 19.1 |
| Macrophages rest | 0.4 | Lung | 8.2 |
| Macrophages LPS | 0.0 | Thymus | 15.8 |
| HUVEC none | 0.2 | Kidney | 100.0 |
| HUVEC starved | 0.0 | | |

CNS_neurodegeneration_v1.0 Summary: Ag6053 Expression of the CG56557-03 gene is low/undetectable in all samples on this panel.

General_screening_panel_v1.5 Summary: Ag6053 The CG56557-03 gene is expressed at low levels in most samples in this panel, with highest expression in CaCo-2 colon cancer cells (CT=30). Significant expression is also seen in some ovarian, colon, renal, CNS cancer cell lines. Hence, expression of this gene could be used as a diagnostic marker and/or for treatment of similar cancers.

In addition, this gene is expressed at low levels in pancreas and adrenal (CT values 33–34). Thus, this gene product may be a small molecule target for the treatment of metabolic diseases including obesity and Types 1 and 2 diabetes. Furthermore, this gene is expressed at higher levels in fetal liver (CT value=31) when compared to expression in adult liver (CT value=36) and may be useful for the differentiation between the two sources of liver tissue.

Panel 4.1D Summary: Ag6053 The CG56557-03 transcript is mostly expressed in kidney (CT=29.5). Low expression of this transcript is also found in colon and thymus. The protein encoded by this transcript may thus be involved in normal tissue/cellular functions in the kidney and colon. Therefore, therapeutics designed with the protein encoded by this transcript may be important in maintaining or restoring normal function to these organs during inflammation.

NOV29e: CG56557-05: Splice Variant of CG56557-01

Expression of gene CG56557-05 was assessed using the primer-probe set Ag6055, described in Table YA. Results of the RTQ-PCR runs are shown in Tables YB and YC.

TABLE YA

Probe Name Ag6055

| Primers | Sequences | Length | Start Position |
|---|---|---|---|
| Forward | 5'-tcaaggtctggaggagacaga-3' (SEQ ID NO: 473) | 21 | 348 |
| Probe | TET-5'-ccatccaaggtcacacgggagg-3'-TAMRA (SEQ ID NO: 474) | 22 | 374 |
| Reverse | 5'- caggttgcctgggacct-3' (SEQ ID NO: 475) | 17 | 405 |

TABLE YB

General_screening_panel_v1.5

| Tissue Name | Rel. Exp. (%) Ag6055, Run 228745663 | Tissue Name | Rel. Exp. (%) Ag6055, Run 228745663 |
|---|---|---|---|
| Adipose | 0.0 | Renal ca. TK-10 | 38.7 |
| Melanoma* Hs688(A).T | 0.0 | Bladder | 9.8 |
| Melanoma* Hs688(B).T | 0.0 | Gastric ca. (liver met.) NCI-N87 | 3.7 |
| Melanoma* M14 | 0.0 | Gastric ca. KATO III | 0.0 |
| Melanoma* LOXIMVI | 0.0 | Colon ca. SW-948 | 0.0 |
| Melanoma* SK-MEL-5 | 0.0 | Colon ca. SW480 | 0.0 |
| Squamous cell carcinoma SCC-4 | 0.0 | Colon ca.* (SW480 met) SW620 | 0.0 |
| Testis Pool | 1.4 | Colon ca. HT29 | 2.6 |
| Prostate ca.* (bone met) PC-3 | 0.0 | Colon ca. HCT-116 | 0.0 |
| Prostate Pool | 0.3 | Colon ca. CaCo-2 | 35.4 |
| Placenta | 0.0 | Colon cancer tissue | 5.7 |
| Uterus Pool | 0.2 | Colon ca. SW1116 | 0.5 |
| Ovarian ca. OVCAR-3 | 0.3 | Colon ca. Colo-205 | 0.0 |
| Ovarian ca. SK-OV-3 | 1.3 | Colon ca. SW-48 | 3.8 |
| Ovarian ca. OVCAR-4 | 0.0 | Colon Pool | 1.2 |
| Ovarian ca. OVCAR-5 | 0.8 | Small Intestine Pool | 0.7 |
| Ovarian ca. IGROV-1 | 0.7 | Stomach Pool | 1.5 |
| Ovarian ca. OVCAR-8 | 0.0 | Bone Marrow Pool | 0.5 |
| Ovary | 0.4 | Fetal Heart | 0.6 |
| Breast ca. MCF-7 | 0.0 | Heart Pool | 0.4 |
| Breast ca. MDA-MB-231 | 0.0 | Lymph Node Pool | 0.6 |
| Breast ca. BT 549 | 0.0 | Fetal Skeletal Muscle | 1.7 |
| Breast ca. T47D | 0.0 | Skeletal Muscle Pool | 1.5 |
| Breast ca. MDA-N | 0.0 | Spleen Pool | 1.2 |
| Breast Pool | 0.0 | Thymus Pool | 1.1 |
| Trachea | 2.6 | CNS cancer (glio/astro) U87-MG | 0.0 |
| Lung | 1.3 | CNS cancer (glio/astro) U-118-MG | 0.0 |
| Fetal Lung | 17.8 | CNS cancer (neuro; met) SK-N-AS | 1.2 |
| Lung ca. NCI-N417 | 0.0 | CNS cancer (astro) SF-539 | 0.0 |
| Lung ca. LX-1 | 0.0 | CNS cancer (astro) SNB-75 | 1.4 |

TABLE YB-continued

General_screening_panel_v1.5

| Tissue Name | Rel. Exp. (%) Ag6055, Run 228745663 | Tissue Name | Rel. Exp. (%) Ag6055, Run 228745663 |
|---|---|---|---|
| Lung ca. NCI-H146 | 0.0 | CNS cancer (glio) SNB-19 | 0.0 |
| Lung ca. SHP-77 | 0.0 | CNS cancer (glio) SF-295 | 1.0 |
| Lung ca. A549 | 5.9 | Brain (Amygdala) Pool | 0.0 |
| Lung ca. NCI-H526 | 0.0 | Brain (cerebellum) | 0.0 |
| Lung ca. NCI-H23 | 0.0 | Brain (fetal) | 0.5 |
| Lung ca. NCI-H460 | 3.4 | Brain (Hippocampus) Pool | 0.4 |
| Lung ca. HOP-62 | 0.0 | Cerebral Cortex Pool | 0.2 |
| Lung ca. NCI-H522 | 0.4 | Brain (Substantia nigra) Pool | 0.0 |
| Liver | 2.2 | Brain (Thalamus) Pool | 0.5 |
| Fetal Liver | 100.0 | Brain (whole) | 0.4 |
| Liver ca. HepG2 | 77.4 | Spinal Cord Pool | 0.9 |
| Kidney Pool | 1.8 | Adrenal Gland | 1.6 |
| Fetal Kidney | 6.9 | Pituitary gland Pool | 0.7 |
| Renal ca. 786-0 | 1.1 | Salivary Gland | 1.6 |
| Renal ca. A498 | 0.0 | Thyroid (female) | 0.0 |
| Renal ca. ACHN | 0.0 | Pancreatic ca. CAPAN2 | 0.0 |
| Renal ca. UO-31 | 0.0 | Pancreas Pool | 1.8 |

TABLE YC

Panel 4.1D

| Tissue Name | Rel. Exp. (%) Ag6055, Run 226160573 | Tissue Name | Rel. Exp. (%) Ag6055, Run 226160573 |
|---|---|---|---|
| Secondary Th1 act | 0.0 | HUVEC IL-1beta | 0.0 |
| Secondary Th2 act | 0.0 | HUVEC IFN gamma | 0.0 |
| Secondary Tr1 act | 0.0 | HUVEC TNF alpha + IFN gamma | 0.0 |
| Secondary Th1 rest | 0.0 | HUVEC TNF alpha + IL4 | 4.2 |
| Secondary Th2 rest | 0.0 | HUVEC IL-11 | 0.0 |
| Secondary Tr1 rest | 0.0 | Lung Microvascular EC none | 0.0 |
| Primary Th1 act | 0.0 | Lung Microvascular EC TNFalpha + IL-1beta | 0.0 |
| Primary Th2 act | 0.0 | Microvascular Dermal EC none | 0.0 |
| Primary Tr1 act | 0.0 | Microvascular Dermal EC TNFalpha + IL-1beta | 0.0 |
| Primary Th1 rest | 0.0 | Bronchial epithelium TNFalpha + IL1beta | 0.7 |
| Primary Th2 rest | 0.0 | Small airway epithelium none | 0.0 |
| Primary Tr1 rest | 0.0 | Small airway epithelium TNFalpha + IL-1beta | 0.0 |
| CD45RA CD4 lymphocyte act | 0.0 | Coronery artery SMC rest | 0.0 |
| CD45RO CD4 lymphocyte act | 0.0 | Coronery artery SMC TNFalpha + IL-1beta | 0.0 |
| CD8 lymphocyte act | 0.0 | Astrocytes rest | 0.0 |
| Secondary CD8 lymphocyte rest | 0.0 | Astrocytes TNFalpha + IL-1beta | 0.0 |
| Secondary CD8 lymphocyte act | 0.0 | KU-812 (Basophil) rest | 0.0 |
| CD4 lymphocyte none | 0.0 | KU-812 (Basophil) PMA/ionomycin | 0.0 |
| 2ry Th1/Th2/Tr1_anti-CD95 CH11 | 0.0 | CCD1106 (Keratinocytes) none | 0.0 |
| LAK cells rest | 0.0 | CCD1106 (Keratinocytes) TNFalpha + IL-1beta | 0.0 |

TABLE YC-continued

Panel 4.1D

| Tissue Name | Rel. Exp. (%) Ag6055, Run 226160573 | Tissue Name | Rel. Exp. (%) Ag6055, Run 226160573 |
|---|---|---|---|
| LAK cells IL-2 | 0.0 | Liver cirrhosis | 0.8 |
| LAK cells IL-2 + IL-12 | 0.0 | NCI-H292 none | 0.0 |
| LAK cells IL-2 + IFN gamma | 0.0 | NCI-H292 IL-4 | 0.0 |
| LAK cells IL-2 + IL-18 | 0.0 | NCI-H292 IL-9 | 0.0 |
| LAK cells PMA/ionomycin | 0.0 | NCI-H292 IL-13 | 0.0 |
| NK Cells IL-2 rest | 2.5 | NCI-H292 IFN gamma | 0.0 |
| Two Way MLR 3 day | 0.0 | HPAEC none | 0.0 |
| Two Way MLR 5 day | 0.0 | HPAEC TNF alpha + IL-1 beta | 0.0 |
| Two Way MLR 7 day | 0.0 | Lung fibroblast none | 0.0 |
| PBMC rest | 0.0 | Lung fibroblast TNF alpha + IL-1 beta | 0.0 |
| PBMC PWM | 0.0 | Lung fibroblast IL-4 | 0.0 |
| PBMC PHA-L | 0.0 | Lung fibroblast IL-9 | 0.0 |
| Ramos (B cell) none | 0.0 | Lung fibroblast IL-13 | 5.0 |
| Ramos (B cell) ionomycin | 0.0 | Lung fibroblast IFN gamma | 0.0 |
| B lymphocytes PWM | 0.0 | Dermal fibroblast CCD1070 rest | 0.0 |
| B lymphocytes CD40L and IL-4 | 0.0 | Dermal fibroblast CCD1070 TNF alpha | 0.0 |
| EOL-1 dbcAMP | 0.0 | Dermal fibroblast CCD1070 IL-1 beta | 0.0 |
| EOL-1 dbcAMP PMA/ionomycin | 0.0 | Dermal fibroblast IFN gamma | 0.0 |
| Dendritic cells none | 0.0 | Dermal fibroblast IL-4 | 0.0 |
| Dendritic cells LPS | 0.0 | Dermal Fibroblasts rest | 0.0 |
| Dendritic cells anti-CD40 | 0.7 | Neutrophils TNFa + LPS | 0.0 |
| Monocytes rest | 0.0 | Neutrophils rest | 4.8 |
| Monocytes LPS | 0.0 | Colon | 100.0 |
| Macrophages rest | 0.0 | Lung | 0.8 |
| Macrophages LPS | 0.0 | Thymus | 4.5 |
| HUVEC none | 0.0 | Kidney | 79.0 |
| HUVEC starved | 0.0 | | |

CNS_neurodegeneration_v1.0 Summary: Ag6055 Expression of the CG56557-05 gene is low/undetectable in all samples on this panel (CTs>35).

General_screening_panel_v1.5 Summary: Ag6055 Highest expression of the CG56557-05 gene is in fetal liver (CT value=31). Furthermore, this gene is expressed at much higher levels in the fetal liver when compared to expression in the adult liver (CT=36). Thus, this gene product may be useful for the differentiation of between the adult and fetal sources of this tissue. Significant expression is also seen in CaCo-2 colon cancer cells, TK-10 renal cells and HepG2 liver cells. Hence, expression of this gene can be used as a diagnostic marker and/or as treatment for related kidney and colon cancers.

Panel 4.1D Summary: Ag6055 The CG56557-05 transcript is selectively expressed at low levels in colon (CT=32.7) and kidney. Thus, the protein encoded for this transcript may be involved in normal tissue/cellular functions. Therefore, therapeutics designed with the protein encoded by this transcript may be important for maintaining or restoring normal function to these organs during inflammation.

NOV30: CG56398-01: Na/Glucose Cotransporter

Expression of gene CG56398-01 was assessed using the primer-probe set Ag2925, described in Table ZA. Results of the RTQ-PCR runs are shown in Tables ZB, ZC, ZD, ZE and ZF.

TABLE ZA

Probe Name Ag2925

| Primers | Sequences | Length | Start Position |
|---|---|---|---|
| Forward | 5'-ctccctcacctccatctttaac-3' (SEQ ID NO: 476) | 22 | 1191 |
| Probe | TET-5'-ccatcttcaccatggacctctggaat-3'-TAMRA (SEQ ID NO: 477) | 26 | 1223 |
| Reverse | 5'-atcatgagctccttctcagatg-3' (SEQ ID NO: 478) | 22 | 1265 |

TABLE ZB

CNS_neurodegeneration_v1.0

| Tissue Name | Rel. Exp. (%) Ag2925, Run 209777392 | Tissue Name | Rel. Exp. (%) Ag2925, Run 209777392 |
| --- | --- | --- | --- |
| AD 1 Hippo | 16.8 | Control (Path) 3 Temporal Ctx | 0.4 |
| AD 2 Hippo | 17.2 | Control (Path) 4 Temporal Ctx | 5.8 |
| AD 3 Hippo | 6.5 | AD 1 Occipital Ctx | 36.1 |
| AD 4 Hippo | 1.4 | AD 2 Occipital Ctx (Missing) | 0.0 |
| AD 5 hippo | 48.3 | AD 3 Occipital Ctx | 10.4 |
| AD 6 Hippo | 17.6 | AD 4 Occipital Ctx | 15.9 |
| Control 2 Hippo | 24.8 | AD 5 Occipital Ctx | 12.4 |
| Control 4 Hippo | 2.6 | AD 6 Occipital Ctx | 33.2 |
| Control (Path) 3 Hippo | 2.1 | Control 1 Occipital Ctx | 2.3 |
| AD 1 Temporal Ctx | 37.9 | Control 2 Occipital Ctx | 57.0 |
| AD 2 Temporal Ctx | 24.3 | Control 3 Occipital Ctx | 6.7 |
| AD 3 Temporal Ctx | 2.5 | Control 4 Occipital Ctx | 11.6 |
| AD 4 Temporal Ctx | 10.5 | Control (Path) 1 Occipital Ctx | 53.6 |
| AD 5 Inf Temporal Ctx | 100.0 | Control (Path) 2 Occipital Ctx | 8.3 |
| AD 5 SupTemporal Ctx | 34.2 | Control (Path) 3 Occipital Ctx | 4.6 |
| AD 6 Inf Temporal Ctx | 24.5 | Control (Path) 4 Occipital Ctx | 5.2 |
| AD 6 Sup Temporal Ctx | 15.4 | Control 1 Parietal Ctx | 6.2 |
| Control 1 Temporal Ctx | 0.5 | Control 2 Parietal Ctx | 37.6 |
| Control 2 Temporal Ctx | 20.0 | Control 3 Parietal Ctx | 12.4 |
| Control 3 Temporal Ctx | 4.8 | Control (Path) 1 Parietal Ctx | 15.1 |
| Control 4 Temporal Ctx | 1.3 | Control (Path) 2 Parietal Ctx | 16.2 |
| Control (Path) 1 Temporal Ctx | 11.9 | Control (Path) 3 Parietal Ctx | 0.5 |
| Control (Path) 2 Temporal Ctx | 5.8 | Control (Path) 4 Parietal Ctx | 13.7 |

TABLE ZC

Panel 1.3D

| Tissue Name | Rel. Exp. (%) Ag2925, Run 158046924 | Tissue Name | Rel. Exp. (%) Ag2925, Run 158046924 |
| --- | --- | --- | --- |
| Liver adenocarcinoma | 0.4 | Kidney (fetal) | 1.2 |
| Pancreas | 0.0 | Renal ca. 786-0 | 0.0 |
| Pancreatic ca. CAPAN2 | 0.0 | Renal ca. A498 | 0.1 |
| Adrenal gland | 0.3 | Renal ca. RXF 393 | 0.0 |
| Thyroid | 0.0 | Renal ca. ACHN | 0.0 |
| Salivary gland | 0.0 | Renal ca. UO-31 | 0.0 |
| Pituitary gland | 0.4 | Renal ca. TK-10 | 0.0 |
| Brain (fetal) | 0.3 | Liver | 0.2 |
| Brain (whole) | 19.5 | Liver (fetal) | 3.8 |
| Brain (amygdala) | 10.5 | Liver ca. (hepatoblast) HepG2 | 0.6 |
| Brain (cerebellum) | 4.6 | Lung | 0.2 |
| Brain (hippocampus) | 100.0 | Lung (fetal) | 0.0 |
| Brain (substantia nigra) | 22.2 | Lung ca. (small cell) LX-1 | 0.0 |
| Brain (thalamus) | 45.4 | Lung ca. (small cell) NCI-H69 | 0.0 |
| Cerebral Cortex | 13.0 | Lung ca. (s. cell var.) SHP-77 | 0.0 |

TABLE ZC-continued

Panel 1.3D

| Tissue Name | Rel. Exp. (%) Ag2925, Run 158046924 | Tissue Name | Rel. Exp. (%) Ag2925, Run 158046924 |
|---|---|---|---|
| Spinal cord | 25.9 | Lung ca. (large cell) NCI-H460 | 0.0 |
| glio/astro U87-MG | 0.0 | Lung ca. (non-sm. cell) A549 | 0.8 |
| glio/astro U-118-MG | 0.4 | Lung ca. (non-s.cell) NCI-H23 | 0.0 |
| astrocytoma SW1783 | 0.1 | Lung ca. (non-s.cell) HOP-62 | 0.0 |
| neuro*; met SK-N-AS | 0.0 | Lung ca. (non-s.cl) NCI-H522 | 0.0 |
| astrocytoma SF-539 | 0.1 | Lung ca. (squam.) SW 900 | 0.0 |
| astrocytoma SNB-19 | 0.0 | Lung ca. (squam.) NCI-H596 | 0.0 |
| glioma SNB-19 | 0.0 | Mammary gland | 0.1 |
| glioma U251 | 0.0 | Breast ca.* (pl.ef) MCF-7 | 0.0 |
| glioma SF-295 | 0.0 | Breast ca.* (pl.ef) MDA-MB-231 | 0.5 |
| Heart (fetal) | 0.1 | Breast ca.* (pl.ef) T47D | 0.0 |
| Heart | 0.0 | Breast ca. BT-549 | 0.3 |
| Skeletal muscle (fetal) | 0.1 | Breast ca. MDA-N | 0.2 |
| Skeletal muscle | 0.0 | Ovary | 0.1 |
| Bone marrow | 0.0 | Ovarian ca. OVCAR-3 | 0.0 |
| Thymus | 0.0 | Ovarian ca. OVCAR-4 | 0.0 |
| Spleen | 0.1 | Ovarian ca. OVCAR-5 | 0.0 |
| Lymph node | 0.1 | Ovarian ca. OVCAR-8 | 0.3 |
| Colorectal | 0.1 | Ovarian ca. IGROV-1 | 0.0 |
| Stomach | 0.0 | Ovarian ca.* (ascites) SK-OV-3 | 0.0 |
| Small intestine | 1.0 | Uterus | 0.0 |
| Colon ca. SW480 | 0.2 | Placenta | 0.4 |
| Colon ca.* SW620 (SW480 met) | 84.7 | Prostate | 0.2 |
| Colon ca. HT29 | 0.2 | Prostate ca.* (bone met) PC-3 | 0.0 |
| Colon ca HCT-116 | 0.0 | Testis | 0.3 |
| Colon ca. CaCo-2 | 0.2 | Melanoma Hs688(A).T | 0.0 |
| Colon ca. tissue (ODO3866) | 0.1 | Melanoma* (met) Hs688(B).T | 0.0 |
| Colon ca. HCC-2998 | 0.7 | Melanoma UACC-62 | 0.1 |
| Gastric ca.* (liver met) NCI-N87 | 0.0 | Melanoma M14 | 0.0 |
| Bladder | 0.0 | Melanoma LOX IMVI | 0.0 |
| Trachea | 0.0 | Melanoma* (met) SK-MEL-5 (met) | 0.0 |
| Kidney | 2.6 | Adipose | 0.0 |

TABLE ZD

Panel 2D

| Tissue Name | Rel. Exp. (%) Ag2925, Run 158047169 | Tissue Name | Rel. Exp. (%) Ag2925, Run 158047169 |
|---|---|---|---|
| Normal Colon | 2.6 | Kidney Margin 8120608 | 63.7 |
| CC Well to Mod Diff | 0.6 | Kidney Cancer | 0.0 |
| Lung Cancer (OD04404) | 0.8 | Liver Cancer 064003 | 0.0 |
| Lung Margin (OD04404) | 0.0 | Liver Cancer 1025 | 0.6 |
| Lung Cancer (OD04565) | 0.0 | Liver Cancer 1026 | 1.2 |
| Lung Margin (OD04565) | 0.4 | Liver Cancer 6004-T | 0.3 |
| Lung Cancer (OD04237-01) | 0.0 | Liver Tissue 6004-N | 3.3 |
| Lung Margin (OD04237-02) | 0.0 | Liver Cancer 6005-T | 0.3 |

TABLE ZD-continued

Panel 2D

| Tissue Name | Rel. Exp. (%) Ag2925, Run 158047169 | Tissue Name | Rel. Exp. (%) Ag2925, Run 158047169 |
|---|---|---|---|
| Ocular Mel Met to Liver (OD04310) | 0.0 | Liver Tissue 6005-N | 0.4 |
| Liver Margin (OD04310) | 0.1 | Normal Bladder | 1.2 |
| Melanoma Mets to Lung (OD04321) | 0.0 | Bladder Cancer 1023 | 0.9 |
| Lung Margin (OD04321) | 0.1 | Bladder Cancer A302173 | 0.4 |
| Normal Kidney | 48.3 | Bladder Cancer (OD04718-01) | 0.7 |
| Kidney Ca, Nuclear grade 2 (OD04338) | 0.9 | Bladder Normal Adjacent (OD04718-03) | 0.0 |
| Kidney Margin (OD04338) | 3.8 | Normal Ovary | 0.0 |
| Kidney Ca Nuclear grade 1/2 (OD04339) | 0.4 | Ovarian Cancer 064008 | 0.1 |
| Kidney Margin (OD04339) | 70.7 | Ovarian Cancer (OD04768-07) | 1.6 |
| Kidney Ca, Clear cell type (OD04340) | 3.0 | Ovary Margin (OD04768-08) | 0.0 |
| Kidney Margin (OD04340) | 11.7 | Normal Stomach | 1.0 |
| Kidney Ca, Nuclear grade 3 (OD04348) | 0.2 | Gastric Cancer 9060358 | 0.0 |
| Kidney Margin (OD04348) | 2.1 | Stomach Margin 9060359 | 0.0 |
| Kidney Cancer (OD04622-01) | 0.0 | Gastric Cancer 9060395 | 0.4 |
| Kidney Margin (OD04622-03) | 2.3 | Stomach Margin 9060394 | 0.7 |
| Kidney Cancer (OD04450-01) | 0.0 | Gastric Cancer 9060397 | 2.4 |
| Kidney Margin (OD03866) | 5.0 | Stomach Margin 8120613 | 0.4 |
| CC Margin (OD03866) | 0.5 | Kidney Margin 8120614 | 100.0 |
| CC Gr.2 rectosigmoid (OD03868) | 0.0 | Kidney Cancer 9010320 | 0.4 |
| CC Margin (OD03868) | 0.4 | Kidney Margin 9010321 | 14.2 |
| CC Mod Diff (OD03920) | 2.0 | Normal Uterus | 0.9 |
| CC Margin (OD03920) | 0.7 | Uterus Cancer 064011 | 0.7 |
| CC Gr. 2 ascend colon (OD03921) | 0.0 | Normal Thyroid | 0.0 |
| CC Margin (OD03921) | 1.2 | Thyroid Cancer 064010 | 0.0 |
| CC from Partial Hepatectomy (OD04309) Mets | 1.5 | Thyroid Cancer A302152 | 0.0 |
| Liver Margin (OD04309) | 0.7 | Thyroid Margin A302153 | 0.4 |
| Colon mets to lung (OD04451-01) | 0.0 | Normal Breast | 0.6 |
| Lung Margin (OD04451-02) | 0.9 | Breast Cancer (OD04566) | 0.9 |
| Normal Prostate 6546-1 | 0.6 | Breast Cancer (OD04590-01) | 1.2 |
| Prostate Cancer (OD04410) | 1.2 | Breast Cancer Mets (OD04590-03) | 0.5 |
| Prostate Margin (OD04410) | 1.2 | Breast Cancer Metastasis (OD04655-05) | 0.9 |
| Prostate Cancer (OD04720-01) | 0.9 | Breast Cancer 064006 | 0.0 |
| Prostate Margin (OD04720-02) | 1.1 | Breast Cancer 1024 | 0.9 |
| Normal Lung 061010 | 0.4 | Breast Cancer 9100266 | 1.4 |
| Lung Met to Muscle OD04286) | 0.0 | Breast Margin 9100265 | 0.0 |
| Muscle Margin (OD04286) | 0.0 | Breast Cancer A209073 | 44.1 |

TABLE ZD-continued

Panel 2D

| Tissue Name | Rel. Exp. (%) Ag2925, Run 158047169 | Tissue Name | Rel. Exp. (%) Ag2925, Run 158047169 |
| --- | --- | --- | --- |
| Lung Malignant Cancer (OD03126) | 1.4 | Breast Margin A2090734 | 1.4 |
| Lung Margin (OD03126) (OD04450-03) | 0.0 | Normal Liver 9060396 | 0.0 |
| Kidney Cancer 8120607 | 0.3 | Gastric Cancer 064005 | 0.6 |

TABLE ZE

Panel 4D

| Tissue Name | Rel. Exp. (%) Ag2925, Run 158047348 | Tissue Name | Rel. Exp. (%) Ag2925, Run 158047348 |
| --- | --- | --- | --- |
| Secondary Th1 act | 1.7 | HUVEC IL-1beta | 0.0 |
| Secondary Th2 act | 0.0 | HUVEC IFN gamma | 0.0 |
| Secondary Tr1 act | 0.6 | HUVEC TNF alpha + IFN gamma | 0.0 |
| Secondary Th1 rest | 0.0 | HUVEC TNF alpha + IL4 | 0.0 |
| Secondary Th2 rest | 0.8 | HUVEC IL-11 | 0.6 |
| Secondary Tr1 rest | 0.0 | Lung Microvascular EC none | 0.2 |
| Primary Th1 act | 0.6 | Lung Microvascular EC TNFalpha + IL-1beta | 0.0 |
| Primary Th2 act | 0.7 | Microvasular Dermal EC none | 0.0 |
| Primary Tr1 act | 0.6 | Microvascular Dermal EC TNFalpha + IL-1beta | 0.0 |
| Primary Th1 rest | 0.8 | Bronchial epithelium TNFalpha + IL1beta | 0.0 |
| Primary Th2 rest | 1.9 | Small airway epithelium none | 0.0 |
| Primary Tr1 rest | 1.6 | Small airway epithelium TNFalpha + IL-1beta | 0.0 |
| CD45RA CD4 lymphocyte act | 0.5 | Coronery artery SMC rest | 0.0 |
| CD45RO CD4 lymphocyte act | 0.6 | Coronery artery SMC TNFalpha + IL-1beta | 0.0 |
| CD8 lymphocyte act | 0.5 | Astrocytes rest | 0.0 |
| Secondary CD8 lymphocyte rest | 0.3 | Astrocytes TNFalpha + IL-1beta | 0.0 |
| Secondary CD8 lymphocyte act | 0.0 | KU-812 (Basophil) rest | 0.0 |
| CD4 lymphocyte none | 0.1 | KU-812 (Basophil) PMA/ionomycin | 0.0 |
| 2ry Th1/Th2/Tr1_anti-CD95 CH11 | 1.2 | CCD1106 (Keratinocytes) none | 0.0 |
| LAK cells rest | 1.1 | CCD1106 (Keratinocytes) TNFalpha + IL-1beta | 0.0 |
| LAK cells IL-2 | 1.1 | Liver cirrhosis | 2.8 |
| LAK cells IL-2 + IL-12 | 1.1 | Lupus kidney | 1.2 |
| LAK cells IL-2 + IFN gamma | 0.0 | NCI-H292 none | 0.5 |
| LAK cells IL-2 + IL-18 | 0.4 | NCI-H292 IL-4 | 0.2 |
| LAK cells PMA/ionomycin | 1.4 | NCI-H292 IL-9 | 1.1 |
| NK Cells IL-2 rest | 0.7 | NCI-H292 IL-13 | 0.6 |
| Two Way MLR 3 day | 2.3 | NCI-H292 IFN gamma | 0.6 |
| Two Way MLR 5 day | 0.8 | HPAEC none | 1.3 |
| Two Way MLR 7 day | 0.5 | HPAEC TNF alpha + IL-1 beta | 0.1 |
| PBMC rest | 0.0 | Lung fibroblast none | 0.7 |
| PBMC PWM | 1.1 | Lung fibroblast TNF alpha + IL-1beta | 0.0 |
| PBMC PHA-L | 0.0 | Lung fibroblast IL-4 | 0.3 |
| Ramos (B cell) none | 0.0 | Lung fibroblast IL-9 | 0.0 |
| Ramos (B cell) ionomycin | 0.0 | Lung fibroblast IL-13 | 0.0 |
| B lymphocytes PWM | 0.6 | Lung fibroblast IFN | 0.0 |

TABLE ZE-continued

Panel 4D

| Tissue Name | Rel. Exp. (%) Ag2925, Run 158047348 | Tissue Name | Rel. Exp. (%) Ag2925, Run 158047348 |
|---|---|---|---|
| B lymphocytes CD40L and IL-4 | 0.4 | Dermal fibroblast CCD1070 rest | 0.0 |
| EOL-1 dbcAMP | 0.0 | Dermal fibroblast CCD1070 TNF alpha | 0.0 |
| EOL-1 dbcAMP PMA/ionomycin | 0.0 | Dermal fibroblast CCD1070 IL:1 beta | 0.0 |
| Dendritic cells none | 1.1 | Dermal fibroblast IFN gamma | 0 0 |
| Dendritic cells LPS | 1.0 | Dermal fibroblast IL-4 | 0.0 |
| Dendritic cells anti-CD40 | 1.1 | IBD Colitis 2 | 0.0 |
| Monocytes rest | 0.6 | IBD Crohn's | 2.9 |
| Monocytes LPS | 0.0 | Colon | 100.0 |
| Macrophages rest | 2.2 | Lung | 2.1 |
| Macrophages LPS | 0.0 | Thymus | 85.3 |
| HUVEC none | 0.8 | Kidney | 2.9 |
| HUVEC starved | 1.6 | | |

TABLE ZF

Panel CNS_1

| Tissue Name | Rel. Exp. (%) Ag2925, Run 171688481 |
|---|---|
| BA4 Control | 3.3 |
| BA4 Control2 | 14.6 |
| BA4 Alzheimer's2 | 3.1 |
| BA4 Parkinson's | 11.3 |
| BA4 Parkinson's2 | 24.5 |
| BA4 Huntington's | 7.7 |
| BA4 Huntington's2 | 5.3 |
| BA4 PSP | 1.5 |
| BA4 PSP2 | 15.2 |
| BA4 Depression | 3.6 |
| BA4 Depression 2 | 6.6 |
| BA7 Control | 3.3 |
| BA7 Control2 | 12.6 |
| BA7 Alzheimer's2 | 0.0 |
| BA7 Parkinson's | 5.2 |
| BA7 Parkinson's | 12.2 |
| BA7 Huntington's | 4.8 |
| BA7 Huntington's2 | 53.2 |
| BA7 PSP | 4.7 |
| BA7 PSP2 | 4.0 |
| BA7 Depression | 7.4 |
| BA9 Control | 0.0 |
| BA9 Control2 | 41.8 |
| BA9 Alzheimer's | 0.0 |
| BA9 Alzheimer's2 | 1.5 |
| BA9 Parkinson's | 10.2 |
| BA9 Parkinson's2 | 29.1 |
| BA9 Huntington's | 10.1 |
| BA9 Huntington's2 | 7.2 |
| BA9 PSP | 4.7 |
| BA9 PSP2 | 3.5 |
| BA9 Depression | 2.8 |
| BA9 Depression2 | 2.6 |
| BA17 Control | 18.7 |
| BA17 Control2 | 8.5 |
| BA17 Alzheimer's2 | 0.0 |
| BA17 Parkinson's | 16.0 |
| BA17 Parkinson's2 | 31.4 |
| BA17 Huntington's | 13.1 |
| BA17 Huntington's2 | 13.6 |
| BA17 Depression | 4.7 |
| BA17 Depression2 | 12.0 |
| BA17 PSP | 3.1 |
| BA17 PSP2 | 1.8 |
| Sub Nigra Control | 66.0 |
| Sub Nigra Control2 | 43.2 |
| Sub Nigra Alzheimer's2 | 25.3 |
| Sub Nigra Parkinson's2 | 85.3 |
| Sub Nigra Huntington's | 100.0 |
| Sub Nigra Huntington's2 | 64.2 |
| Sub Nigra PSP2 | 14.4 |
| Sub Nigra Depression | 19.2 |
| Sub Nigra Depression2 | 15.0 |
| Glob Palladus Control | 31.2 |
| Glob Palladus Control2 | 5.3 |
| Glob Palladus Alzheimer's | 12.3 |
| Glob Palladus Alzheimer's2 | 5.4 |
| Glob Palladus Parkinson's | 28.1 |
| Glob Palladus Parkinson's2 | 10.2 |
| Glob Palladus PSP | 6.1 |
| Glob Palladus PSP2 | 0.0 |
| Glob Palladus Depression | 13.7 |
| Temp Pole Control | 0.0 |
| Temp Pole Control2 | 13.3 |
| Temp Pole Alzheimer's | 0.0 |
| Temp Pole Alzheimer's2 | 0.0 |
| Temp Pole Parkinson's | 3.2 |
| Temp Pole Parkinson's2 | 4.7 |
| Temp Pole Huntington's | 8.7 |
| Temp Pole PSP | 0.0 |
| Temp Pole PSP2 | 1.4 |
| Temp Pole Depression2 | 3.3 |
| Cing Gyr Control | 29.3 |
| Cing Gyr Control2 | 19.1 |
| Cing Gyr Alzheimer's | 21.8 |
| Cing Gyr Alzheimer's2 | 0.9 |
| Cing Gyr Parkinson's | 28.3 |
| Cing Gyr Parkinson's2 | 30.1 |
| Cing Gyr Huntington's | 45.1 |
| Cing Gyr Huntington's2 | 64.6 |
| Cing Gyr PSP | 17.8 |
| Cing Gyr PSP2 | 4.4 |
| Cing Gyr Depression | 6.1 |
| Cing Gyr Depression2 | 25.9 |

CNS_neurodegeneration_v1.0 Summary: Ag2925 This panel does not show differential expression of the CG56398-

01 gene in Alzheimer's disease. However, this expression profile confirms the presence of this gene in the brain. Please see Panel 1.3D for discussion of utility of this gene in the central nervous system.

Panel 1.3D Summary: Ag2925 Expression of the CG56398-01 gene appears to be brain-specific. Highest expression is detected in the hippocampus (CT=28) a region that degenerates in Alzheimer's disease. Thus, this gene would be useful for distinguishing brain tissue from non-neural tissue, and may be beneficial as a drug target in neurodegenerative disease.

Panel 2D Summary: Ag2925 The CG56398-01 gene is most highly expressed in a normal kidney sample (CT=28.95). Interestingly, expression of this gene is lost in the adjacent cancer samples. Hence, the loss of expression could potentially be used as a diagnostic marker for kidney cancer. This gene is also expressed at low levels in breast and bladder cancer samples and is absent or extremely low in normal adjacent tissue. Therefore, therapeutic inhibition of the activity of this protein product, through the use of small molecule drugs or antibodies, may be useful in the treatment of breast and bladder cancer or as a diagnostic marker for the presence of these cancers.

Panel 4D Summary: Ag2925 Expression of the CG56398-01 transcript is almost exclusively restricted to colon and thymus, with highest expression in normal colon (CT=29). Furthermore, it is expressed at much lower levels in IBD colon. Therefore, the protein encoded by this transcript may be involved in normal tissue/cellular functions in the kidney and colon. Loss-of-expression of this protein may serve as a diagnostic marker for lupus or IBD.

Panel CNS_1 Summary: Ag2925 This panel confirms expression of the CG56398-01 gene in the brain. Please see Panel 1.3D for discussion of utility of this gene in the central nervous system.

NOV31: CG56616-01: Olfactory Receptor

Expression of gene CG56616-01 was assessed using the primer-probe sets Ag1371 and Ag2014, described in Tables AAA, AAB, and AAC. Results of the RTQ-PCR runs are shown in Tables AAD, AAE, AAF and AAG.

TABLE AAA

Probe Name Ag1371

| Primers | Sequences | Length | Start Position |
|---|---|---|---|
| Forward | 5'-ctcaccttcacacccctatgta-3' (SEQ ID NO:479) | 22 | 938 |
| Probe | TET-5'-ctttctggggaacctctccttcttgg-3'-TAMRA (SEQ ID NO:480) | 26 | 909 |
| Reverse | 5'-gaatagaggtggtggtgtagca-3' (SEQ ID NO: 481) | 22 | 882 |

TABLE AAB

Probe Name Ag1656

| Primers | Sequences | Length | Start Position |
|---|---|---|---|
| Forward | 5'-tgataacattctgtgggaccat-3' (SEQ ID NO:482) | 22 | 353 |
| Probe | TET-5'-cctcatgtacatgaagcccaagtctca-3'-TAMRA (SEQ ID NO:483) | 27 | 323 |
| Reverse | 5'-ggcatccaagtcatctgaatta-3' (SEQ ID NO:484) | 22 | 292 |

TABLE AAC

Probe Name Ag2014

| Primers | Sequences | Length | Start Position |
|---|---|---|---|
| Forward | 5'-ctcaccttcacacccctatgta-3' (SEQ ID NO:485) | 22 | 938 |
| Probe | TET-5'-ctttctggggaacctctccttcttgg-3'-TAMRA (SEQ ID NO:486) | 26 | 909 |
| Reverse | 5'-gaatagaggtggtggtgtagca-3' (SEQ ID NO:487) | 22 | 882 |

TABLE AAD

Panel 1.2

| Tissue Name | Rel. Exp. (%) Ag1371, Run 133713412 |
|---|---|
| Endothelial cells | 0.0 |
| Heart (Fetal) | 0.8 |
| Pancreas | 0.0 |
| Pancreatic ca. CAPAN 2 | 0.0 |
| Adrenal Gland | 1.2 |
| Thyroid | 5.3 |
| Salivary gland | 0.0 |
| Pituitary gland | 35.6 |
| Brain (fetal) | 3.0 |
| Brain (whole) | 3.7 |
| Brain (amygdala) | 15.9 |
| Brain (cerebellum) | 1.8 |
| Brain (hippocampus) | 24.1 |
| Brain (thalamus) | 13.9 |
| Cerebral Cortex | 100.0 |
| Spinal cord | 6.4 |
| glio/astro U87-MG | 0.8 |
| glio/astro U-118-MG | 0.1 |
| astrocytoma SW1783 | 0.0 |
| neuro*; met SK-N-AS | 0.7 |
| astrocytoma SF-539 | 1.4 |
| astrocytoma SNB-75 | 0.0 |
| glioma SNB-19 | 4.4 |
| glioma U251 | 0.0 |
| glioma SF-295 | 0.8 |
| Heart | 0.0 |
| Skeletal Muscle | 1.6 |
| Bone marrow | 0.4 |
| Thymus | 1.0 |
| Spleen | 2.0 |
| Lymph node | 0.3 |
| Colorectal Tissue | 8.0 |
| Stomach | 0.0 |
| Small intestine | 1.6 |
| Colon ca. SW480 | 0.0 |
| Colon ca.* SW620 (SW480 met) | 0.0 |
| Colon ca. HT29 | 1.2 |
| Colon ca. HCT-116 | 0.0 |
| Colon ca. CaCo-2 | 3.5 |
| Colon ca. Tissue (ODO3866) | 30.6 |
| Colon ca. HCC-2998 | 0.0 |
| Gastric ca.* (liver met) NCI-N87 | 0.1 |
| Bladder | 5.0 |
| Trachea | 0.1 |
| Kidney | 0.2 |
| Kidney (fetal) | 18.0 |
| Renal ca. 786-0 | 0.0 |
| Renal ca. A498 | 11.7 |
| Renal ca. RXF 393 | 0.0 |
| Renal ca. ACHN | 0.1 |
| Renal ca. UO-31 | 0.3 |
| Renal ca. TK-10 | 0.0 |
| Liver | 16.0 |
| Liver (fetal) | 1.3 |
| Liver ca. (hepatoblast) HepG2 | 0.0 |
| Lung | 0.1 |
| Lung (fetal) | 0.0 |

TABLE AAD-continued

Panel 1.2

| Tissue Name | Rel. Exp. (%) Ag1371, Run 133713412 |
|---|---|
| Lung ca. (small cell) LX-1 | 0.0 |
| Lung ca. (small cell) NCI-H69 | 18.2 |
| Lung ca. (s. cell var.) SHP-77 | 0.3 |
| Lung ca. (large cell) NCI-H460 | 0.0 |
| Lung ca. (non-sm. cell) A549 | 2.8 |
| Lung ca. (non-s. cell) NCI-H23 | 0.0 |
| Lung ca. (non-s. cell) HOP-62 | 4.5 |
| Lung ca. (non-s. cl) NCI-H522 | 0.0 |
| Lung ca. (squam.) SW900 | 1.6 |
| Lung ca. (squam.) NCI-H596 | 2.6 |
| Mammary gland | 0.1 |
| Breast ca.* (pl. ef) MCF-7 | 0.0 |
| Breast ca.* (pl. ef) MDA-MB-231 | 0.0 |
| Breast ca.* (pl. ef) T47D | 1.8 |
| Breast ca. BT-549 | 2.0 |
| Breast ca. MDA-N | 0.5 |
| Ovary | 4.1 |
| Ovarian ca. OVCAR-3 | 14.2 |
| Ovarian ca. OVCAR-4 | 3.5 |
| Ovarian ca. OVCAR-5 | 14.9 |
| Ovarian ca. OVCAR-8 | 3.7 |
| Ovarian ca. IGROV-1 | 2.0 |
| Ovarian ca. (ascites) SK-OV-3 | 0.0 |
| Uterus | 0.0 |
| Placenta | 0.0 |
| Prostate | 0.0 |
| Prostate ca.* (bone met) PC-3 | 11.7 |
| Testis | 1.4 |
| Melanoma Hs688(A).T | 0.0 |
| Melanoma* (met) Hs688(B).T | 1.2 |
| Melanoma UACC-62 | 0.0 |
| Melanoma M14 | 8.2 |
| Melanoma LOX IMVI | 0.0 |
| Melanoma* (met) SK-MEL-5 | 0.0 |

TABLE AAE

Panel 1.3D

| Tissue Name | Rel. Exp. (%) Ag2014, Run 147837460 |
|---|---|
| Liver adenocarcinoma | 0.0 |
| Pancreas | 0.0 |
| Pancreatic ca. CAPAN 2 | 0.0 |
| Adrenal gland | 0.0 |
| Thyroid | 9.9 |
| Salivary gland | 0.0 |
| Pituitary gland | 74.7 |
| Brain (fetal) | 9.5 |
| Brain (whole) | 43.8 |
| Brain (amygdala) | 15.0 |
| Brain (cerebellum) | 17.8 |
| Brain (hippocampus) | 31.9 |
| Brain (*substantia nigra*) | 0.0 |
| Brain (thalamus) | 6.9 |
| Cerebral Cortex | 89.5 |
| Spinal cord | 25.2 |
| glio/astro U87-MG | 5.4 |
| glio/astro U-118-MG | 0.0 |
| astrocytoma SW1783 | 5.8 |
| neuro*; met SK-N-AS | 8.5 |
| astrocytoma SF-539 | 5.5 |
| astrocytoma SNB-75 | 0.0 |
| glioma SNB-19 | 0.0 |
| glioma U251 | 0.0 |
| glioma SF-295 | 0.0 |
| Heart (fetal) | 0.0 |
| Heart | 0.0 |
| Skeletal muscle (fetal) | 79.0 |
| Skeletal muscle | 0.0 |

TABLE AAE-continued

Panel 1.3D

| Tissue Name | Rel. Exp. (%) Ag2014, Run 147837460 |
|---|---|
| Bone marrow | 0.0 |
| Thymus | 11.8 |
| Spleen | 9.1 |
| Lymph node | 8.2 |
| Colorectal | 60.7 |
| Stomach | 0.0 |
| Small intestine | 0.0 |
| Colon ca. SW480 | 0.0 |
| Colon ca.* SW620 (SW480 met) | 0.0 |
| Colon ca. HT29 | 0.0 |
| Colon ca. HCT-116 | 0.0 |
| Colon ca. CaCo-2 | 9.2 |
| Colon ca. tissue (ODO3866) | 4.6 |
| Colon ca. HCC-2998 | 6.8 |
| Gastric ca.* (liver met) NCI-N87 | 22.1 |
| Bladder | 0.0 |
| Trachea | 42.9 |
| Kidney | 7.3 |
| Kidney (fetal) | 7.0 |
| Renal ca. 786-0 | 9.9 |
| Renal ca. A498 | 66.9 |
| Renal ca. RXF 393 | 0.0 |
| Renal ca. ACHN | 0.0 |
| Renal ca. UO-31 | 0.0 |
| Renal ca. TK-10 | 0.0 |
| Liver | 0.0 |
| Liver (fetal) | 0.0 |
| Liver ca. (hepatoblast) HepG2 | 6.7 |
| Lung | 0.0 |
| Lung (fetal) | 9.6 |
| Lung ca. (small cell) LX-1 | 17.3 |
| Lung ca. (small cell) NCI-H69 | 0.0 |
| Lung ca. (s. cell var.) SHP-77 | 7.4 |
| Lung ca. (large cell) NCI-H460 | 0.0 |
| Lung ca. (non-sm. cell) A549 | 0.0 |
| Lung ca. (non-s. cell) NCI-H23 | 11.0 |
| Lung ca. (non-s. cell) HOP-62 | 3.8 |
| Lung ca. (non-s. cl) NCI-H522 | 0.0 |
| Lung ca. (squam.) SW900 | 15.5 |
| Lung ca. (squam.) NCI-H596 | 0.0 |
| Mammary gland | 0.0 |
| Breast ca.* (pl. ef) MCF-7 | 0.0 |
| Breast ca.* (pl. ef) MDA-MB-231 | 0.0 |
| Breast ca.* (pl. ef) T47D | 0.0 |
| Breast ca. BT-549 | 5.8 |
| Breast ca. MDA-N | 0.0 |
| Ovary | 4.5 |
| Ovarian ca. OVCAR-3 | 100.0 |
| Ovarian ca. OVCAR-4 | 0.0 |
| Ovarian ca. OVCAR-5 | 10.6 |
| Ovarian ca. OVCAR-8 | 0.0 |
| Ovarian ca. IGROV-1 | 0.0 |
| Ovarian ca.* (ascites) SK-OV-3 | 28.7 |
| Uterus | 0.0 |
| Placenta | 0.0 |
| Prostate | 0.0 |
| Prostate ca.* (bone met) PC-3 | 7.4 |
| Testis | 31.0 |
| Melanoma Hs688(A).T | 0.0 |
| Melanoma* (met) Hs688(B).T | 37.6 |
| Melanoma UACC-62 | 0.0 |
| Melanoma M14 | 0.0 |
| Melanoma LOX IMVI | 0.0 |
| Melanoma* (met) SK-MEL-5 | 0.0 |
| Adipose | 0.0 |

TABLE AAF

Panel 2.2

| Tissue Name | Rel. Exp. (%) Ag2014, Run 174232805 |
|---|---|
| Normal Colon | 11.0 |
| Colon cancer (OD06064) | 0.0 |
| Colon Margin (OD06064) | 0.0 |
| Colon cancer (OD06159) | 0.0 |
| Colon Margin (OD06159) | 0.0 |
| Colon cancer (OD06297-04) | 15.1 |
| Colon Margin (OD06297-015) | 0.0 |
| CC Gr.2 ascend colon (ODO03921) | 0.0 |
| CC Margin (ODO3921) | 0.0 |
| Colon cancer metastasis (OD06104) | 0.0 |
| Lung Margin (OD06104) | 0.0 |
| Colon mets to lung (OD04451-01) | 0.0 |
| Lung Margin (OD04451-02) | 0.0 |
| Normal Prostate | 0.0 |
| Prostate Cancer (OD04410) | 0.0 |
| Prostate Margin (OD04410) | 0.0 |
| Normal Ovary | 54.3 |
| Ovarian cancer (OD06283-03) | 0.0 |
| Ovarian Margin (OD06283-07) | 13.9 |
| Ovarian Cancer 064008 | 70.2 |
| Ovarian cancer (OD06145) | 0.0 |
| Ovarian Margin (OD06145) | 30.6 |
| Ovarian cancer (OD06455-03) | 0.0 |
| Ovarian Margin (OD06455-07) | 2.7 |
| Normal Lung | 0.0 |
| Invasive poor diff. lung adeno (ODO4945-01) | 2.7 |
| Lung Margin (ODO4945-03) | 0.0 |
| Lung Malignant Cancer (OD03126) | 0.0 |
| Lung Margin (OD03126) | 0.0 |
| Lung Cancer (OD05014A) | 0.0 |
| Lung Margin (OD05014B) | 0.0 |
| Lung cancer (OD06081) | 0.0 |
| Lung Margin (OD06081) | 14.3 |
| Lung Cancer (OD04237-01) | 0.0 |
| Lung Margin (OD04237-02) | 0.0 |
| Ocular Melanoma Metastasis | 0.0 |
| Ocular Melanoma Margin (Liver) | 0.0 |
| Melanoma Metastasis | 0.0 |
| Melanoma Margin (Lung) | 0.0 |
| Normal Kidney | 12.8 |
| Kidney Ca, Nuclear grade 2 (OD04338) | 37.6 |
| Kidney Margin (OD04338) | 18.6 |
| Kidney Ca Nuclear grade 1/2 (OD04339) | 100.0 |
| Kidney Margin (OD04339) | 0.0 |
| Kidney Ca, Clear cell type (OD04340) | 0.0 |
| Kidney Margin (OD04340) | 21.5 |
| Kidney Ca, Nuclear grade 3 (OD04348) | 0.0 |
| Kidney Margin (OD04348) | 34.6 |
| Kidney malignant cancer (OD06204B) | 9.7 |
| Kidney normal adjacent tissue (OD06204E) | 0.0 |
| Kidney Cancer (OD04450-01) | 29.5 |
| Kidney Margin OD04450-03) | 31.4 |
| Kidney Cancer 8120613 | 0.0 |
| Kidney Margin 8120614 | 0.0 |
| Kidney Cancer 9010320 | 0.0 |
| Kidney Margin 9010321 | 12.3 |
| Kidney Cancer 8120607 | 0.0 |
| Kidney Margin 8120608 | 0.0 |
| Normal Uterus | 0.0 |
| Uterine Cancer 064011 | 54.7 |
| Normal Thyroid | 0.0 |
| Thyroid Cancer 064010 | 8.5 |
| Thyroid Cancer A302152 | 95.9 |
| Thyroid Margin A302153 | 0.0 |
| Normal Breast | 35.6 |
| Breast Cancer (OD04566) | 0.0 |
| Breast Cancer 1024 | 16.4 |
| Breast Cancer (OD04590-01) | 0.0 |
| Breast Cancer Mets (OD04590-03) | 21.3 |
| Breast Cancer Metastasis (OD04655-05) | 12.7 |
| Breast Cancer 064006 | 0.0 |
| Breast Cancer 9100266 | 0.0 |
| Breast Margin 9100265 | 17.8 |
| Breast Cancer A209073 | 0.0 |
| Breast Margin A2090734 | 36.1 |
| Breast cancer (OD06083) | 21.0 |
| Breast cancer node metastasis (OD06083) | 20.3 |
| Normal Liver | 85.9 |
| Liver Cancer 1026 | 0.0 |
| Liver Cancer 1025 | 85.9 |
| Liver Cancer 6004-T | 31.9 |
| Liver Tissue 6004-N | 0.0 |
| Liver Cancer 6005-T | 0.0 |
| Liver Cancer 6005-N | 35.6 |
| Liver Cancer 064003 | 0.0 |
| Normal Bladder | 0.0 |
| Bladder Cancer 1023 | 0.0 |
| Bladder Cancer A302173 | 0.0 |
| Normal Stomach | 14.1 |
| Gastric Cancer 9060397 | 0.0 |
| Stomach Margin 9060396 | 17.2 |
| Gastric Cancer 9060395 | 0.0 |
| Stomach Margin 9060394 | 0.0 |
| Gastric Cancer 064005 | 0.0 |

TABLE AAG

Panel 4D

| Tissue Name | Rel. Exp. (%) Ag2014, Run 158961232 |
|---|---|
| Secondary Th1 act | 0.0 |
| Secondary Th2 act | 0.0 |
| Secondary Tr1 act | 0.0 |
| Secondary Th1 rest | 0.0 |
| Secondary Th2 rest | 0.0 |
| Secondary Tr1 rest | 0.0 |
| Primary Th1 act | 0.0 |
| Primary Th2 act | 0.0 |
| Primary Tr1 act | 0.0 |
| Primary Th1 rest | 0.0 |
| Primary Th2 rest | 0.0 |
| Primary Tr1 rest | 0.0 |
| CD45RA CD4 lymphocyte act | 0.0 |
| CD45RO CD4 lymphocyte act | 0.0 |
| CD8 lymphocyte act | 0.0 |
| Secondary CD8 lymphocyte rest | 0.0 |
| Secondary CD8 lymphocyte act | 0.0 |
| CD4 lymphocyte none | 0.0 |
| 2ry Th1/Th2/Tr1_anti-CD95 CH11 | 0.0 |
| LAK cells rest | 0.0 |
| LAK cells IL-2 | 0.0 |
| LAK cells IL-2 + IL-12 | 0.0 |
| LAK cells IL-2 + IFN gamma | 0.0 |
| LAK cells IL-2 + IL-18 | 0.0 |
| LAK cells PMA/ionomycin | 0.0 |
| NK Cells IL-2 rest | 0.0 |
| Two Way MLR 3 day | 0.0 |
| Two Way MLR 5 day | 0.0 |
| Two Way MLR 7 day | 0.0 |
| PBMC rest | 0.0 |
| PBMC PWM | 0.0 |
| PBMC PHA-L | 0.0 |
| Ramos (B cell) none | 0.0 |
| Ramos (B cell) ionomycin | 0.0 |
| B lymphocytes PWM | 0.0 |
| B lymphocytes CD40L and IL-4 | 0.0 |
| EOL-1 dbcAMP | 0.0 |
| EOL-1 dbcAMP PMA/ionomycin | 0.0 |
| Dendritic cells none | 0.0 |
| Dendritic cells LPS | 0.0 |
| Dendritic cells anti-CD40 | 0.0 |
| Monocytes rest | 0.0 |
| Monocytes LPS | 0.0 |

TABLE AAG-continued

Panel 4D

| Tissue Name | Rel. Exp. (%) Ag2014, Run 158961232 |
|---|---|
| Macrophages rest | 0.0 |
| Macrophages LPS | 0.0 |
| HUVEC none | 0.0 |
| HUVEC starved | 0.0 |
| HUVEC IL-1 beta | 0.0 |
| HUVEC IFN gamma | 0.0 |
| HUVEC TNF alpha + IFN gamma | 0.0 |
| HUVEC TNF alpha + IL4 | 0.0 |
| HUVEC IL-11 | 0.0 |
| Lung Microvascular EC none | 0.0 |
| Lung Microvascular EC TNF alpha + IL-1 beta | 0.0 |
| Microvascular Dermal EC none | 0.0 |
| Microsvasular Dermal EC TNF alpha + IL-1 beta | 0.0 |
| Bronchial epithelium TNF alpha + IL-1 beta | 0.0 |
| Small airway epithelium none | 0.0 |
| Small airway epithelium TNF alpha + IL-1 beta | 0.0 |
| Coronery artery SMC rest | 0.0 |
| Coronery artery SMC TNF alpha + IL-1 beta | 0.0 |
| Astrocytes rest | 0.0 |
| Astrocytes TNF alpha + IL-1 beta | 0.0 |
| KU-812 (Basophil) rest | 0.0 |
| KU-812 (Basophil) PMA/ionomycin | 0.0 |
| CCD1106 (Keratinocytes) none | 0.0 |
| CCD1106 (Keratinocytes) TNF alpha + IL-1 beta | 0.0 |
| Liver cirrhosis | 0.0 |
| Lupus kidney | 0.0 |
| NCI-H292 none | 0.0 |
| NCI-H292 IL-4 | 0.0 |
| NCI-H292 IL-9 | 100.0 |
| NCI-H292 IL-13 | 0.0 |
| NCI-H292 IFN gamma | 0.0 |
| HPAEC none | 0.0 |
| HPAEC TNF alpha + IL-1 beta | 0.0 |
| Lung fibroblast none | 0.0 |
| Lung fibroblast TNF alpha + IL-1 beta | 0.0 |
| Lung fibroblast IL-4 | 0.0 |
| Lung fibroblast IL-9 | 0.0 |
| Lung fibroblast IL-13 | 0.0 |
| Lung fibroblast IFN gamma | 0.0 |
| Dermal fibroblast CCD1070 rest | 0.0 |
| Dermal fibroblast CCD1070 TNF alpha | 0.0 |
| Dermal fibroblast CCD1070 IL-1 beta | 0.0 |
| Dermal fibroblast IFN gamma | 0.0 |
| Dermal fibroblast IL-4 | 0.0 |
| IBD Colitis 2 | 0.0 |
| IBD Crohn's | 0.0 |
| Colon | 0.0 |
| Lung | 0.0 |
| Thymus | 0.0 |
| Kidney | 0.0 |

Panel 1.2 Summary: Ag1371 Expression of the CG56616-01 gene in this panel is seen in a number of normal tissues including colon, small intestine, bone marrow, thymus, spleen, lymph node, bladder, fetal kidney, ovary, and testis.

In addition, the CG56616-01 transcript is present in a number of metabolically relevant tissues, with low expression in adrenal gland (CT=33) and skeletal muscle (CT=32.6), and moderate expression in thyroid (CT=30.8), pituitary (CT=28) and liver (CT=29.2). Therefore, this gene product may be involved in signal transduction pathways in thyroid, pituitary and liver, and may be a drug target for any disease involving one or more of these tissues. For example, this GPCR shows high expression in the pituitary, which controls much endocrine secretion through response to hypophysiotrophic hormones (such as thyrotropin-releasing hormone, somatostatin, somatocrinin, gonadotropin-releasing hormone, corticotropin-releasing hormone) in the posterior pituitary, and response to peripheral hormones (e.g., estrogen, testosterone, etc) in the anterior pituitary. There are a number of diseases associated with pituitary pathophysiology, including hyper- and hypothyroidism, gigantism, dwarfism, acromegaly, Addison's disease, Cushing's disease, diabetes insipidus. Therefore, therapeutic modulation, blockade, treatment with antagonists, or stimulation of the GPCR encoded by the CG56616-01 gene may be useful in the treatment of one or more of these diseases.

The CG56616-01 gene is expressed at low to moderate levels throughout the CNS, including in amygdala, cerebellum, hippocampus, thalamus, spinal cord and developing brain, with highest expression in cerebral cortex (CT=26.6). The CG56616-01 gene encodes a putative GPCR. Several neurotransmitter receptors are GPCRs, including the dopamine receptor family, the serotonin receptor family, the GABAB receptor, muscarinic acetylcholine receptors, and others; thus this GPCR may represent a novel neurotransmitter receptor. Targeting various neurotransmitter receptors (dopamine, serotonin) has proven to be an effective therapy in psychiatric illnesses such as schizophrenia, bipolar disorder and depression. Furthermore, the cerebral cortex and hippocampus are regions of the brain that are known to play critical roles in Alzheimer's disease, seizure disorders, and in the normal process of memory formation. Therefore, therapeutic modulation of the CG56616-01 gene or its protein product may be beneficial in the treatment of one or more of these diseases, as may stimulation and/or blockade of the receptor coded for by the gene. Levels of this gene are high, however, in areas outside of the central nervous system (such as the liver), suggesting the possibility of a wider role in intercellular signaling.

Interestingly, the CG56616-01 gene appears to be expressed by a cluster of cell lines derived from melanoma, prostate cancer, lung cancer and ovarian cancer. In addition, this gene seems to be more highly expressed by adult liver when compared to fetal liver and expressed more highly in fetal kidney when compared to adult kidney. Thus, these data indicate that expression of the CG56616-01 gene might be useful in the distinction of adult vs. fetal liver or kidney tissue. Therapeutic application of the CG56616-01 protein might be of use in the treatment of diseases involving the liver in which the diseased state resembles fetal liver. In contrast this gene seems to be expressed by fetal kidney when compared to adult kidney. Thus, application of the CG56616-01 protein might be useful in the treatment of kidney disorders that require tissue regeneration. Also, therapeutic modulation of the CG56616-01 gene product, through the use of small molecule drugs or antibodies might be of use in the treatment of ovarian cancer, prostate cancer, lung cancer or melanoma.

Panel 1.3D Summary: Ag2014 Significant expression of the CG56616-01 gene is detected in pituitary gland (CT=34.7), cerebral cortex (CT=34.5), fetal skeletal muscle (CT=34.6), and an ovarian cancer cell line (CT=34.3). These results are consistent with what is observed in other panels and the potential implications are discussed above and below. A second experiment with the probe/primer set Ag1656 shows low/undetectable levels of expression in all the samples on this panel (CTs>35).

Panel 2.2 Summary: Ag2014 Expression of the CG56616-01 gene in panel 2.2 is generally low. However, there is significant expression in samples from kidney cancer, thyroid cancer, liver derived tissue (both normal and malignant) and ovarian derived tissue (both normal and malignant). Of particular interest is the comparison of CG56616-01 gene expression between samples of kidney and thyroid cancers and their respective normal adjacent tissue samples. In both cases the CG56616-01 gene is overexpressed in the malignant tissue when compared to the normal adjacent tissue. Thus, based on these data, therapeutic modulation of the activity of the CG56616-01 gene product, through the use of small molecule drugs or antibodies, may be of use in the treatment of kidney or thyroid cancer. A second experiment with the probe/primer set Ag1656 shows low/undetectable levels of expression in all the samples on this panel (CTs>35).

Panel 4D Summary: Ag2014 The H292 lung epithelial cell line expresses the CG56616-01 gene after IL-9-stimulation. Therefore, the putative GPCR encoded by the CG56616-01 gene may be involved in lung inflammation and mucus secretion (ref. 1). Antibodies or small molecule therapeutics that block the function of this membrane protein may thus be useful as anti-inflammatory therapeutics for the treatment of asthma and emphysema. Very low expression is also detected in a number of other samples including IBD colitis 2 (CT=34.1), Crohn's (CT=34.9), thymus (CT=34.8), kidney (CT=34.8), monocytes treated with LPS (CT=34.7) and astrocytes treated with TNFalpha+IL-1beta (CT=34). A second experiment with the probe/primer set Ag1656 shows low/undetectable levels of expression in all the samples on this panel (CTs>35).

REFERENCES

1. Louahed J., Toda M., Jen J., Hamid Q., Renauld J. C., Levitt R. C., Nicolaides N. C. (2000) Interleukin-9 upregulates mucus expression in the airways. Am. J. Respir. Cell. Mol. Biol. 22: 649–656.
2. Interleukin (IL)-9 has recently been shown to play an important role in allergic disease because its expression is strongly associated with the degree of airway responsiveness and the asthmatic-like phenotype. IL-9 is a pleiotropic cytokine that is active on many cell types involved in the allergic immune response. Mucus hypersecretion is a clinical feature of chronic airway diseases; however, the mechanisms underlying the induction of mucin are poorly understood. In this report, we show that IL-9 regulates the expression of a subset of mucin genes in lung cells both in vivo and in vitro. In vivo, the constitutive expression of IL-9 in transgenic mice results inelevated MUC2 and MUC5AC gene expression in airway epithelial cells and periodic acid-Schiff-positive staining (reflecting mucousglycogenates). Similar results were observed in C57BL/6J mice after IL-9 intratracheal instillation. In contrast, instillation of the Thelper 1-associated cytokine interferon gamma failed to induce mucin production. In vitro, our studies showed that IL9 also induces expression of MUC2 and MUC5AC in human primary lung cultures and in the human muccoepidermoid NCI-H292 cell line, indicating a direct effect of IL-9 on inducing mucin expression in these cells. Altogether, these results suggest that upregulation of mucin by IL-9 might contribute to the pathogenesis of human inflammatory airway disorders, such as asthma. These data extend the role of the biologic processes that IL-9 has on regulating the many clinical features of asthma and further supports the IL-9 pathway as a key mediator of the asthmatic response.

NOV32: 153065222/CG56234-02: Splice variant of PCK2

Expression of gene CG56234-02 was assessed using the primer-probe set Ag5111, described in Table ABA. Results of the RTQ-PCR runs are shown in Tables ABB and ABC.

TABLE ABA

Probe Name Ag5111

| Primers | Sequences | Length | Start Position |
|---|---|---|---|
| Forward | 5'-ctgggaggccccaga-3' (SEQ ID NO:488) | 15 | 1377 |
| Probe | TET-5'-tgtccccattgacgccatcatc-3'-TAMRA (SEQ ID NO:489) | 22 | 1395 |
| Reverse | 5'-gatgatcttccctttgggtct-3' (SEQ ID NO:490) | 21 | 1429 |

TABLE ABB

General_screening_panel_v1.5

| Tissue Name | Rel. Exp. (%) Ag5111, Run 228980587 |
|---|---|
| Adipose | 2.0 |
| Melanoma* Hs688(A).T | 31.9 |
| Melanoma* Hs688(B).T | 28.3 |
| Melanoma* M14 | 9.9 |
| Melanoma* LOXIMVI | 4.5 |
| Melanoma* SK-MEL-5 | 39.8 |
| Squamous cell carcinoma SCC-4 | 4.7 |
| Testis Pool | 1.6 |
| Prostate ca.* (bone met) PC-3 | 55.1 |
| Prostate Pool | 0.5 |
| Placenta | 0.3 |
| Uterus Pool | 0.6 |
| Ovarian ca. OVCAR-3 | 13.6 |
| Ovarian ca. SK-OV-3 | 5.3 |
| Ovarian ca. OVCAR-4 | 7.1 |
| Ovarian ca. OVCAR-5 | 34.6 |
| Ovarian ca. IGROV-1 | 22.5 |
| Ovarian ca. OVCAR-8 | 100.0 |
| Ovary | 0.0 |
| Breast ca. MCF-7 | 87.7 |
| Breast ca. MDA-MB-231 | 12.6 |
| Breast ca. BT 549 | 75.8 |
| Breast ca. T47D | 10.1 |
| Breast ca. MDA-N | 16.4 |
| Breast Pool | 0.5 |
| Trachea | 4.3 |
| Lung | 0.0 |
| Fetal Lung | 2.0 |
| Lung ca. NCI-N417 | 1.8 |
| Lung ca. LX-1 | 8.2 |
| Lung ca. NCI-H146 | 11.1 |
| Lung ca. SNB-77 | 11.3 |
| Lung ca. A549 | 11.4 |
| Lung ca. NCI-H526 | 1.8 |
| Lung ca. NCI-H23 | 83.5 |
| Lung ca. NCI-H460 | 27.0 |
| Lung ca. HOP-62 | 1.0 |
| Lung ca. NCI-H522 | 67.4 |
| Liver | 6.3 |
| Fetal Liver | 6.7 |
| Liver ca. HepG2 | 24.7 |
| Kidney Pool | 0.8 |
| Fetal Kidney | 1.0 |
| Renal ca. 786-0 | 8.7 |
| Renal ca. A498 | 1.5 |
| Renal ca. ACHN | 9.3 |
| Renal ca. UO-31 | 1.9 |
| Renal ca. TK-10 | 29.1 |
| Bladder | 12.1 |
| Gastric ca. (liver met.) NCI-N87 | 31.4 |
| Gastric ca. KATO III | 28.1 |
| Colon ca. SW-948 | 17.9 |
| Colon ca. SW480 | 14.9 |
| Colon ca.* (SW480 met) SW620 | 29.5 |
| Colon ca. HT29 | 8.6 |
| Colon ca. HCT-116 | 11.0 |
| Colon ca. CaCo-2 | 44.4 |
| Colon cancer tissue | 9.7 |

TABLE ABB-continued

General_screening_panel_v1.5

| Tissue Name | Rel. Exp. (%) Ag5111, Run 228980587 |
|---|---|
| Colon ca. SW1116 | 1.4 |
| Colon ca. Colo-205 | 6.6 |
| Colon ca. SW-48 | 14.4 |
| Colon Pool | 0.1 |
| Small Intestine Pool | 0.6 |
| Stomach Pool | 1.1 |
| Bone Marrow Pool | 0.5 |
| Fetal Heart | 0.0 |
| Heart Pool | 0.0 |
| Lymph Node Pool | 0.8 |
| Fetal Skeletal Muscle | 0.6 |
| Skeletal Muscle Pool | 0.4 |
| Spleen Pool | 1.7 |
| Thymus Pool | 0.4 |
| CNS cancer (glio/astro) U87-MG | 18.8 |
| CNS cancer (glio/astro) U-118-MG | 9.3 |
| CNS cancer (neuro; met) SK-N-AS | 7.5 |
| CNS cancer (astro) SF-539 | 11.3 |
| CNS cancer (astro) SNB-75 | 48.6 |
| CNS cancer (glio) SNB-19 | 31.0 |
| CNS cancer (glio) SF-295 | 32.5 |
| Brain (Amygdala) Pool | 0.4 |
| Brain (cerebellum) | 0.3 |
| Brain (fetal) | 0.3 |
| Brain (Hippocampus) Pool | 2.5 |
| Cerebral Cortex Pool | 0.4 |
| Brain (*Substantia nigra*) Pool | 0.0 |
| Brain (Thalamus) Pool | 1.0 |
| Brain (whole) | 0.7 |
| Spinal Cord Pool | 1.1 |
| Adrenal Gland | 1.6 |
| Pituitary gland Pool | 0.4 |
| Salivary Gland | 0.9 |
| Thyroid (female) | 0.7 |
| Pancreatic ca. CAPAN2 | 12.8 |
| Pancreas Pool | 0.8 |

TABLE ABC

Panel 4.1D

| Tissue Name | Rel. Exp. (%) Ag5111, Run 226444761 |
|---|---|
| Secondary Th1 act | 90.8 |
| Secondary Th2 act | 40.9 |
| Secondary Tr1 act | 57.4 |
| Secondary Th1 rest | 27.2 |
| Secondary Th2 rest | 6.0 |
| Secondary Tr1 rest | 7.2 |
| Primary Th1 act | 32.8 |
| Primary Th2 act | 49.0 |
| Primary Tr1 act | 50.0 |
| Primary Th1 rest | 6.0 |
| Primary Th2 rest | 6.4 |
| Primary Tr1 rest | 18.0 |
| CD45RA CD4 lymphocyte act | 95.9 |
| CD45RO CD4 lymphocyte act | 95.3 |
| CD8 lymphocyte act | 77.4 |
| Secondary CD8 lymphocyte rest | 90.1 |
| Secondary CD8 lymphocyte act | 21.0 |
| CD4 lymphocyte none | 0.0 |
| 2ry Th1/Th2/Tr1_anti-CD95 CH11 | 5.4 |
| LAK cells rest | 43.5 |
| LAK cells IL-2 | 52.1 |
| LAK cells IL-2 + IL-12 | 33.7 |
| LAK cells IL-2 + IFN gamma | 57.0 |
| LAK cells IL-2 + IL-18 | 46.0 |
| LAK cells PMA/ionomycin | 43.5 |
| NK Cells IL-2 rest | 60.7 |
| Two Way MLR 3 day | 32.1 |

TABLE ABC-continued

Panel 4.1D

| Tissue Name | Rel. Exp. (%) Ag5111, Run 226444761 |
|---|---|
| Two Way MLR 5 day | 53.2 |
| Two Way MLR 7 day | 23.5 |
| PBMC rest | 6.1 |
| PBMC PWM | 23.5 |
| PBMC PHA-L | 35.8 |
| Ramos (B cell) none | 58.6 |
| Ramos (B cell) ionomycin | 71.7 |
| B lymphocytes PWM | 21.6 |
| B lymphocytes CD40L and IL-4 | 29.7 |
| EOL-1 dbcAMP | 32.3 |
| EOL-1 dbcAMP PMA/ionomycin | 10.6 |
| Dendritic cells none | 66.0 |
| Dendritic cells LPS | 31.4 |
| Dendritic cells anti-CD40 | 48.3 |
| Monocytes rest | 29.1 |
| Monocytes LPS | 37.6 |
| Macrophages rest | 100.0 |
| Macrophages LPS | 28.1 |
| HUVEC none | 7.9 |
| HUVEC starved | 17.4 |
| HUVEC IL-1 beta | 18.7 |
| HUVEC IFN gamma | 2.8 |
| HUVEC TNF alpha + IFN gamma | 5.0 |
| HUVEC TNF alpha + IL4 | 23.2 |
| HUVEC IL-11 | 2.3 |
| Lung Microvascular EC none | 3.2 |
| Lung Microvascular EC TNF alpha + IL-1 beta | 6.4 |
| Microvascular Dermal EC none | 6.6 |
| Microsvasular Dermal EC TNF alpha + IL-1 beta | 0.0 |
| Bronchial epithelium TNF alpha + IL-1 beta | 8.7 |
| Small airway epithelium none | 2.2 |
| Small airway epithelium TNF alpha + IL-1 beta | 11.8 |
| Coronery artery SMC rest | 18.3 |
| Coronery artery SMC TNF alpha + IL-1 beta | 9.4 |
| Astrocytes rest | 2.1 |
| Astrocytes TNF alpha + IL-1 beta | 0.0 |
| KU-812 (Basophil) rest | 25.9 |
| KU-812 (Basophil) PMA/ionomycin | 26.8 |
| CCD1106 (Keratinocytes) none | 15.2 |
| CCD1106 (Keratinocytes) TNF alpha + IL-1 beta | 9.0 |
| Liver cirrhosis | 8.3 |
| NCI-H292 none | 15.3 |
| NCI-H292 IL-4 | 13.5 |
| NCI-H292 IL-9 | 14.2 |
| NCI-H292 IL-13 | 29.1 |
| NCI-H292 IFN gamma | 44.8 |
| HPAEC none | 2.0 |
| HPAEC TNF alpha + IL-1 beta | 7.2 |
| Lung fibroblast none | 21.2 |
| Lung fibroblast TNF alpha + IL-1 beta | 11.5 |
| Lung fibroblast IL-4 | 2.4 |
| Lung fibroblast IL-9 | 17.6 |
| Lung fibroblast IL-13 | 13.4 |
| Lung fibroblast IFN gamma | 11.6 |
| Dermal fibroblast CCD1070 rest | 99.3 |
| Dermal fibroblast CCD1070 TNF alpha | 74.7 |
| Dermal fibroblast CCD1070 IL-1 beta | 29.9 |
| Dermal fibroblast IFN gamma | 13.3 |
| Dermal fibroblast IL-4 | 12.2 |
| Dermal Fibroblasts rest | 0.0 |
| Neutrophils TNFa + LPS | 0.0 |
| Neutrophils rest | 0.0 |
| Colon | 32.3 |
| Lung | 3.5 |
| Thymus | 12.1 |
| Kidney | 83.5 |

CNS_neurodegeneration_v1.0 Summary: Ag5111Expression of the CG56234-02 gene is low/undetectable in all samples on this panel (CTs>35).

General_screening_panel_v 1.5 Summary: Ag5111 Highest expression of the CG56234-02 gene is seen in an ovarian cancer cell line (CT=30). This gene encodes a splice variant of PEPCK2, the rate-limiting enzyme in gluconeogenesis that has been shown to be regulated in response to hormones and environmental stress. In addition, to the ovarian cancer cell line, this gene is expressed at a moderate level in most of the cancer cell lines used in this panel. Therefore, modulation of the gene product using small molecule drugs may affect the growth and survival of cancer cells. Expression of this gene could potentially be used as a diagnostic marker of the metabolic status of cells and inhibition of activity of this gene product might be used for therapeutic treatment of cancers.

This gene is also moderately expressed (CT values=34) in adult and fetal liver. Inhibition of this enzyme could potentially decrease hepatic glucose production and thus serve as an effective treatment for Type 2 diabetes, which is characterized by excess hepatic glucose production.

Panel 4.1D Summary: Ag 5111 The CG56234-02 transcript is expressed at low levels in a wide range of cell across this panel (CTs=33.3–34.4), including CD4 T cells (naive and memory T cells), CD8 T cells, B cells and macrophages. Expression of this transcript is also found in dermal fibroblasts and kidney. This transcript encodes a homolog of a key enzyme in glucogenesis and therefore may be important for the metabolic status of all these cell types that contribute to the inflammatory response. Therefore, modulation of the activity or expression of this putative protein by small molecules could affect the activity of these cells and be useful for the treatment of autoimmune diseases such as inflammatory bowel diseases, rheumatoid arthritis, asthma, COPD, psoriasis and lupus.

Example 2

SNP Analysis of NOVX Clones

SeqCallingTM Technology: cDNA was derived from various human samples representing multiple tissue types, normal and diseased states, physiological states, and developmental states from different donors. Samples were obtained as whole tissue, cell lines, primary cells or tissue cultured primary cells and cell lines. Cells and cell lines may have been treated with biological or chemical agents that regulate gene expression for example, growth factors, chemokines, steroids. The cDNA thus derived was then sequenced using CuraGen's proprietary SeqCalling technology. Sequence traces were evaluated manually and edited for corrections if appropriate. cDNA sequences from all samples were assembled with themselves and with public ESTs using bioinformatics programs to generate CuraGen's human SeqCalling database of SeqCalling assemblies. Each assembly contains one or more overlapping cDNA sequences derived from one or more human samples. Fragments and ESTs were included as components for an assembly when the extent of identity with another component of the assembly was at least 95% over 50 bp. Each assembly can represent a gene and/or its variants such as splice forms and/or single nucleotide polymorphisms (SNPs) and their combinations. Variant sequences are included in this application. A variant sequence can include a single nucleotide polymorphism (SNP). A SNP can, in some instances, be referred to as a "cSNP" to denote that the nucleotide sequence containing the SNP originates as a cDNA. A SNP can arise in several ways. For example, a SNP may be due to a substitution of one nucleotide for another at the polymorphic site. Such a substitution can be either a transition or a transversion. A SNP can also arise from a deletion of a nucleotide or an insertion of a nucleotide, relative to a reference allele. In this case, the polymorphic site is a site at which one allele bears a gap with respect to a particular nucleotide in another allele. SNPs occurring within genes may result in an alteration of the amino acid encoded by the gene at the position of the SNP. Intragenic SNPs may also be silent, however, in the case that a codon including a SNP encodes the same amino acid as a result of the redundancy of the genetic code. SNPs occurring outside the region of a gene, or in an intron within a gene, do not result in changes in any amino acid sequence of a protein but may result in altered regulation of the expression pattern for example, alteration in temporal expression, physiological response regulation, cell type expression regulation, intensity of expression, stability of transcribed message.

Method of novel SNP Identification: SNPs are identified by analyzing sequence assemblies using CuraGen's proprietary SNPTool algorithm. SNPTool identifies variation in assemblies with the following criteria: SNPs are not analyzed within 10 base pairs on both ends of an alignment; Window size (number of bases in a view) is 10; The allowed number of mismatches in a window is 2; Minimum SNP base quality (PHRED score) is 23; Minimum number of changes to score an SNP is 2/assembly position. SNPTool analyzes the assembly and displays SNP positions, associated individual variant sequences in the assembly, the depth of the assembly at that given position, the putative assembly allele frequency, and the SNP sequence variation. Sequence traces are then selected and brought into view for manual validation. The consensus assembly sequence is imported into CuraTools along with variant sequence changes to identify potential amino acid changes resulting from the SNP sequence variation. Comprehensive SNP data analysis is then exported into the SNPCalling database.

Method of Novel SNP Confirmation:

SNPs are confirmed employing a validated method know as Pyrosequencing (Pyrosequencing, Westborough, Mass.). Detailed protocols for Pyrosequencing can be found in: Alderborn et al. Determination of Single Nucleotide Polymorphisms by Real-time Pyrophosphate DNA Sequencing. (2000). *Genome Research.* 10, Issue 8, August. 1249–1265. In brief, Pyrosequencing is a real time primer extension process of genotyping. This protocol takes double-stranded, biotinylated PCR products from genomic DNA samples and binds them to streptavidin beads. These beads are then denatured producing single stranded bound DNA. SNPs are characterized utilizing a technique based on an indirect bioluminometric assay of pyrophosphate (PPi) that is released from each dNTP upon DNA chain elongation. Following Klenow polymerase-mediated base incorporation, PPi is released and used as a substrate, together with adenosine 5'-phosphosulfate (APS), for ATP sulfurylase, which results in the formation of ATP. Subsequently, the ATP accomplishes the conversion of luciferin to its oxiderivative by the action of luciferase. The ensuing light output becomes proportional to the number of added bases, up to about four bases. To allow processivity of the method dNTP excess is degraded by apyrase, which is also present in the starting reaction mixture, so that only dNTPs are added to the template during the sequencing. The process has been fully automated and adapted to a 96-well format, which allows rapid screening of large SNP panels. The DNA and protein sequences for the novel single nucleotide polymorphic variants are reported. Variants are reported individually but any combination of all or a select subset of variants are also included. In addition, the positions of the variant bases and the variant amino acid residues are underlined.

Results

Variants are reported individually but any combination of all or a select subset of variants are also included as contemplated NOVX embodiments of the invention.

NOV4a SNP Data

The DNA and protein sequences for the novel single nucleotide polymorphic variants of the Myotonic dystrophy kinase-related CDC42-binding kinase-like gene of NOV4a are reported in Table 4I. Variants are reported individually but any combination of all or a select subset of variants are also included. In summary, there are 4 variants reported.

TABLE 4I cSNP and Coding Variants for NOV4a

| Variant | Base Position of cSNP | Wild Type | Variant | Amino Acid Change |
|---|---|---|---|---|
| 13376286 | 204 | T | C | Leu → Pro at aa 36 |
| 13376289 | 351 | T | C | Val → Ala at aa 85 |
| 13376290 | 467 | G | A | Val → Met at aa 124 |
| 13376281 | 3331 | G | A | no change (silent) |

NOV6 SNP Data

The DNA and protein sequences for the novel single nucleotide polymorphic variants of the GPCR-like gene of NOV6 are reported in Table 6H. Variants are reported individually but any combination of all or a select subset of variants are also included. In summary, there are 2 variants reported.

TABLE 6H cSNP and Coding Variants for NOV6

| Variant | Base Position of cSNP | Wild Type | Variant | Amino Acid Change |
|---|---|---|---|---|
| 13376566 | 217 | T | C | Ile → Thr at aa 63 |
| 13376567 | 1036 | T | C | Val → Ala at aa 336 |

NOV8a SNP Data

The DNA and protein sequences for the novel single nucleotide polymorphic variants of the Carboxypeptidase-like gene of NOV8a are reported in Table 8M. Variants are reported individually but any combination of all or a select subset of variants are also included. In summary, there are 14 variants reported.

TABLE 8M cSNP and Coding Variants for NOV8a

| Variant | Base Position of cSNP | Wild Type | Variant | Amino Acid Change |
|---|---|---|---|---|
| 13375069 | 116 | A | G | Asp → Gly at aa 34 |
| 13375068 | 125 | T | C | Val → Ala at aa 37 |
| 13375363 | 270 | A | G | Ile → Met at aa 85 |
| 13375364 | 417 | G | T | Arg → Ser at aa 134 |
| 13375365 | 579 | A | T | silent |
| 13375366 | 658 | A | G | Thr → Ala at aa 215 |
| 13375367 | 674 | G | A | Ser → Asn at aa 220 |
| 13375368 | 925 | C | T | Pro → Ser at aa 304 |
| 13375063 | 953 | A | G | Asp → Gly at aa 313 |
| 13375064 | 955 | A | T | Ser → Cys at aa 314 |
| 13375369 | 963 | A | G | silent |
| 13375065 | 983 | A | G | Glu → Gly at aa 323 |
| 13375370 | 1037 | T | C | Leu → pro at aa 341 |
| 13375371 | 1083 | G | A | silent |

NOV8b SNP Data

In the following positions, one or more consensus positions (Cons. Pos.) of the nucleotide sequence have been identified as SNPs. NOV8b has 7 SNP variants, whose variant positions for its nucleotide and amino acid sequences is numbered according to SEQ ID NOS:21 and 22, respectively. The nucleotide sequence of the NOV8b variant differs as shown in Table 8N.

TABLE 8N cSNP and Coding Variants for NOV8b

| NT Position of cSNP | Wild Type NT | Variant NT |
|---|---|---|
| 240 | A | G |
| 295 | A | G |
| 442 | G | T |
| 950 | C | T |
| 988 | A | G |
| 1062 | T | C |
| 1108 | G | A |

NOV9 SNP Data

The DNA and protein sequences for the novel single nucleotide polymorphic variants of the Neurotransmitter Receptor-like gene of NOV9 are reported in Table 9G. Variants are reported individually but any combination of all or a select subset of variants are also included. In summary, there is 1 variant reported.

TABLE 9G cSNP and Coding Variants for NOV9

| Variant | Base Position of cSNP | Wild Type | Variant | Amino Acid Change |
|---|---|---|---|---|
| 13376754 | 752 | T | C | silent |

NOV11a SNP Data

The DNA and protein sequences for the novel single nucleotide polymorphic variants of the Lysyl oxidase-like gene of NOV11a are reported in Table 11I. Variants are reported individually but any combination of all or a select subset of variants are also included. In summary, there are 3 variants reported.

TABLE 11I cSNP and Coding Variants for NOV11a

| Variant | Base Position of cSNP | Wild Type | Variant | Amino Acid Change |
|---|---|---|---|---|
| 13376750 | 1880 | C | T | silent |
| 13376749 | 2150 | C | T | silent |
| 13376748 | 2576 | T | C | silent |

NOV11b SNP Data:

In the following positions, one or more consensus positions (Cons. Pos.) of the nucleotide sequence have been identified as SNPs. NOV11b has 11 SNP variants, whose variant positions for its nucleotide and amino acid sequences is numbered according to SEQ ID NOS:33 and 34, respectively. The nucleotide sequence of the NOV11b variant differs as shown in Table 11J.

TABLE 11J cSNP and Coding Variants for NOV29f

| NT Position of cSNP | Wild Type NT | Variant NT |
|---|---|---|
| 753 | A | T |
| 758 | A | T |
| 762 | G | A |
| 778 | G | A |
| 780 | T | C |
| 1711 | G | C |
| 1786 | G | A |
| 1894 | T | C |
| 2170 | T | C |
| 2589 | T | C |
| 2601 | T | C |

NOV12a SNP Data

The DNA and protein sequences for the novel single nucleotide polymorphic variants of the Phosphatase-like gene of NOV12a are reported in Table 12I. Variants are reported individually but any combination of all or a select subset of variants are also included. In summary, there is 1 variant reported.

TABLE 12I cSNP and Coding Variants for NOV12a

| Variant | Base Position of cSNP | Wild Type | Variant | Amino Acid Change |
|---|---|---|---|---|
| 13376751 | 185 | C | T | silent |

NOV13 SNP Data

The DNA and protein sequences for the novel single nucleotide polymorphic variants of the Chloride Channel Protein CLC-KA-like gene of NOV13 are reported in Table 13 G. Variants are reported individually but any combination of all or a select subset of variants are also included. In summary, there is 1 variant reported.

In FIG. 3, the positions of the variant bases and the variant amino acid residues are underlined. in FIG. 3. Variant is a T to C SNP at 425 bp of the nucleotide sequence that results in no change in the protein sequence (silent).

TABLE 13G cSNP and Coding Variants for NOV13

| Variant | Base Position of cSNP | Wild Type | Variant | Amino Acid Change |
|---|---|---|---|---|
| 13376442 | 425 | T | C | silent |

NOV15a SNP Data

The DNA and protein sequences for the novel single nucleotide polymorphic variants of the MEGF6-like gene of NOV15a are reported in Table 15Q. Variants are reported individually but any combination of all or a select subset of variants are also included. In summary, there are 4 variants reported.

TABLE 15Q cSNP and Coding Variants for NOV15a

| Variant | Base Position of cSNP | Wild Type | Variant | Amino Acid Change |
|---|---|---|---|---|
| 13374463 | 522 | C | T | silent |
| 13374464 | 712 | C | T | Gln → End at aa 238 |
| 13376752 | 6567 | A | G | silent |
| 13376753 | 7184 | A | G | silent |

NOV16 SNP Data:

In the following positions, one or more consensus positions (Cons. Pos.) of the nucleotide sequence have been identified as SNPs. NOV16 has 3 SNP variants, whose variant positions for its nucleotide and amino acid sequences is numbered according to SEQ ID NOS:55 and 56, respectively. The nucleotide sequence of the NOV16 variant differs as shown in Table 16G.

TABLE 16G cSNP and Coding Variants for NOV16

| NT Position of cSNP | Wild Type NT | Variant NT |
|---|---|---|
| 485 | A | C |
| 742 | T | C |
| 831 | G | T |

NOV17a SNP Data

The DNA and protein sequences for the novel single nucleotide polymorphic variants of the PEST-containing transporter-like gene of NOV1 7a are reported in Table 17I. Variants are reported individually but any combination of all or a select subset of variants are also included. In summary, there are 2 variants reported.

TABLE 17I cSNP and Coding Variants for NOV17a

| Variant | Base Position of cSNP | Wild Type | Variant | Amino Acid Change |
|---|---|---|---|---|
| 13374524 | between 554 and 555 |  | insertion of T | frameshift with all amino acids after 184 discordant |
| 13374525 | 661 | C | T | silent |

NOV18a SNP Data

The DNA and protein sequences for the novel single nucleotide polymorphic variants of the GPCR-like gene of NOV18a are reported in Table 18H. Variants are reported individually but any combination of all or a select subset of variants are also included. In summary, there are 1 variants reported.

TABLE 18H cSNP and Coding Variants for NOV18a

| Variant | Base Position of cSNP | Wild Type | Variant | Amino Acid Change |
|---|---|---|---|---|
| 13374523 | 477 | G | A | Trp → End at aa 147 |

NOV18b SNP Data:

In the following positions, one or more consensus positions (Cons. Pos.) of the nucleotide sequence have been identified as SNPs. NOV18b has 1 SNP variants, whose variant positions for its nucleotide and amino acid sequences is numbered according to SEQ ID NOS:63 and 62, respectively. The nucleotide sequence of the NOV18b variant differs as shown in Table 18I.

TABLE 18I cSNP and Coding Variants for NOV29f

| NT Position of cSNP | Wild Type NT | Variant NT |
| --- | --- | --- |
| 627 | G | A |

NOV19b SNP Data:

In the following positions, one or more consensus positions (Cons. Pos.) of the nucleotide sequence have been identified as SNPs. NOV19b has one SNP variant, whose variant positions for its nucleotide and amino acid sequences is numbered according to SEQ ID NOS:66 and 67, respectively. The nucleotide sequence of the NOV19b variant differs as shown in Table 19I.

TABLE 19I cSNP and Coding Variants for NOV19b

| NT Position of cSNP | Wild Type NT | Variant NT |
| --- | --- | --- |
| 1682 | A | G |

NOV29f SNP Data:

In the following positions, one or more consensus positions (Cons. Pos.) of the nucleotide sequence have been identified as SNPs. NOV29f has nine SNP variants, whose variant positions for its nucleotide and amino acid sequences is numbered according to SEQ ID NOS:114 and 115, respectively. The nucleotide sequence of the NOV29f variant differs as shown in Table 29Q.

TABLE 29Q cSNP and Coding Variants for NOV29f

| NT Position of cSNP | Wild Type NT | Variant NT |
| --- | --- | --- |
| 135 | T | C |
| 209 | G | A |
| 258 | G | A |
| 265 | T | C |
| 273 | C | T |
| 278 | A | G |
| 436 | A | G |

TABLE 29Q-continued cSNP and Coding Variants for NOV29f

| NT Position of cSNP | Wild Type NT | Variant NT |
| --- | --- | --- |
| 551 | A | G |
| 735 | G | A |

NOV31 SNP Data:

In the following positions, one or more consensus positions (Cons. Pos.) of the nucleotide sequence have been identified as SNPs. NOV31 has ten SNP variants, whose variant positions for its nucleotide and amino acid sequences is numbered according to SEQ ID NOS:118 and 119, respectively. The nucleotide sequence of the NOV31 variant differs as shown in Table 31H.

TABLE 31H cSNP and Coding Variants for NOV31

| NT Position of cSNP | Wild Type NT | Variant NT |
| --- | --- | --- |
| 260 | G | A |
| 650 | C | T |
| 651 | T | C |
| 777 | C | G |
| 787 | C | T |
| 789 | A | G |
| 790 | G | C |
| 798 | A | G |
| 828 | T | A |
| 982 | A | G |

Example 3

Identification of NOVX Clones

The novel NOVX target sequences identified in the present invention were subjected to the exon linking process to confirm the sequence. PCR primers were designed by starting at the most upstream sequence available, for the forward primer, and at the most downstream sequence available for the reverse primer. Table 34A shows the sequences of the PCR primers used for obtaining different clones for NOV1–18, if any. PCR primers for NOV19–33, if any, are disclosed separately within their respective section above. In each case, the sequence was examined, walking inward from the respective termini toward the coding sequence, until a suitable sequence that is either unique or highly selective was encountered, or, in the case of the reverse primer, until the stop codon was reached. Such primers were designed based on in silico predictions for the fall length cDNA, part (one or more exons) of the DNA or protein sequence of the target sequence, or by translated homology of the predicted exons to closely related human sequences from other species. These primers were then employed in PCR amplification based on the following pool of human cDNAs: adrenal gland, bone marrow, brain—amygdala, brain cerebellum, brain—hippocampus, brain—substantia nigra, brain—thalamus, brain—whole, fetal brain, fetal kidney, fetal liver, fetal lung, heart, kidney, lymphoma—Raji, mammary gland, pancreas, pituitary gland, placenta, prostate, salivary gland, skeletal muscle, small intestine, spinal cord, spleen, stomach, testis, thyroid, trachea, uterus.

TABLE 34A

PCR Primer Sequences

| NOVX Clone | Forward Primer (5' → 3') | Reverse Primer (5' → 3') |
| --- | --- | --- |
| NOV3 variants | AGATCTAAGGGCCGGACCGCACTCTTCCTGGCCACG (SEQ ID NO:491) | CTCGAGTTCATCCACAGCCAGCACTGTGGCCCCATG (SEQ ID NO:492) |
| NOV4a | CATGGAGCGGCGGCTGC (SEQ ID NO:493) | GCACAAAAGGGTCCTTCAGCATCTC (SEQ ID NO:494) |
| NOV5 | CTCCAACATGGCAAAAATCTCC (SEQ ID NO:495) | CAAGGGGTCCTCAGTTCCACTT (SEQ ID NO:496) |
| NOV7b | ATGTCGAGGCTCAGCTGGGGATAC (SEQ ID NO:497) | GGGGGAGTTCATTGGTGACAATTTTA (SEQ ID NO:498) |
| NOV8b | GATGCATTCATTCTCAAGGACACTTGA (SEQ ID NO:499) | CCTGGGCAGAATGCACTTAGAGAAGAG (SEQ ID NO:500) |
| NOV9 | CAATGGTGAACAATTTCTCC (SEQ ID NO:501) | TCAAGTTAGTTTTGAGGTCTCTACA (SEQ ID NO:502) |
| NOV11b | CGCGCTCCATCTGGTATCTTG (SEQ ID NO:503) | TGACTGGGTTTCCTTACAGAAGAGGAG (SEQ ID NO:504) |
| NOV12b | GGAGGCCAACAGAGTCCCTACAG (SEQ ID NO:505) | CAAAGGGAAAAGGGAGTAGTAAAGCTG (SEQ ID NO:506) |
| NOV13 | GGGCCTGATGGAGGAGTTTGTG (SEQ ID NO:507) | ATCTTGCTGGGCCGGCTCACTT (SEQ ID NO:508) |
| NOV16 | CATGGAGACAAGAAATTACTCTGCCA (SEQ ID NO:509) | AAGCTCTCTTGCCCCATTGAGGATAT (SEQ ID NO:510) |
| NOV17a | GAGGCGGCTGTCGAGAAGGT (SEQ ID NO:511) | ATAATAGAGTCAGATTCTTTCTTGAACATTCCAG (SEQ ID NO:512) |

Usually the resulting amplicons were gel purified, cloned and sequenced to high redundancy. The PCR product derived from exon linking was cloned into the pCR2.1 vector from Invitrogen. The resulting bacterial clone has an insert covering the entire open reading frame cloned into the pCR2.1 vector. Table 34B shows a list of these bacterial clones for NOV1–18, if any. Bacterial clones for NOV19–33, if any, are treated in their respective sections above. The resulting sequences from all clones were assembled with themselves, with other fragments in CuraGen Corporation's database and with public ESTs. Fragments and ESTs were included as components for an assembly when the extent of their identity with another component of the assembly was at least 95% over 50 bp. In addition, sequence traces were evaluated manually and edited for corrections if appropriate. These procedures provide the sequence reported herein.

TABLE 34B

Bacterial Clones

| NOVX Clone | Bacterial Clone (Physical clone) |
| --- | --- |
| NOV5 | AC027667.698177.A5 |
| NOV6 | 117832::GM432e15__A.698346.H10 FLC EL |
| NOV7b | SC133786449__A.698496.E5 |
| NOV8b | CG55794-01.698509.A5 |
| NOV9 | 111169::sggc_draft__ba435e4__20000825.698301.A18 |
| NOV11b | 127289::CG56319-01.698563.B13 |
| NOV12b | CG56436-01.698590.I11 |

TABLE 34B-continued

Bacterial Clones

| NOVX Clone | Bacterial Clone (Physical clone) |
| --- | --- |
| NOV13 | sggc_draft__ba254i4__20000907.698365.M10 |
| NOV15d | 121848::SC111823923__2.642041.P7 |
| NOV16 | AL359846__A.698352.F6 |
| NOV18b | 117869::sggc_draft__dj824k2__20000907.698336.H1 |

Other Embodiments

Although particular embodiments have been disclosed herein in detail, this has been done by way of example for purposes of illustration only, and is not intended to be limiting with respect to the scope of the appended claims, which follow. In particular, it is contemplated by the inventors that various substitutions, alterations, and modifications may be made to the invention without departing from the spirit and scope of the invention as defined by the claims. The choice of nucleic acid starting material, clone of interest, or library type is believed to be a matter of routine for a person of ordinary skill in the art with knowledge of the embodiments described herein. Other aspects, advantages, and modifications considered to be within the scope of the following claims.

SEQUENCE LISTING (512 sequences)

SEQ ID NO: 1 - DNA, 796 bp, Homo sapiens
  CDS (1)..(774): no start codon
agcaagggcttccccataatcctggcaggcaggcctcccctggggtttccaacttctgaccccactgaagtgtttatcctcttctctaaccccagcctccttttccctgtctccatgtgctctgagagatgctctgagagatgctcccactcccccaggctccctctgcatccccctcattttcttcctccccagtgtgtcaatggagtcctggcccccaccctctcgacattgtcaccttttcctgatccaaagtgggaccttcttttcccccaagtggtcctgtctaggggtgccgctgccgggccccctctggtcttcctgctgcagactggggccttttgggagtcagcaggcgcccgggccaaccgcagccagcgtgaggcgagcgatgcttcaccggcgagtcatcagggtgagctggccgtgtgcgatgcagtcagtgtctgggtgacagatcccgggactgctgtggacttggttgtgctcgaggtggaggtgttgggcgaggtgcctgcagctgtcggcagttccctccaccaacacttctttgttgcccacttcgaggccgataactctgaggaaggtggcccgggggtaggtggaggggctgccgccggggtgtggaccggggggcactgggtgtctgagtgcaaggccaagcagtcctatgtgcgggcattgaccgctgatgcccagggccgtgtggactggcgatggattcaaattggcactgcctgtgtctgcacactcctcagccggactggccgggcctgagacccatgcccaggaactg

SEQ ID NO: 2 - protein, 258 aa, Homo sapiens
SKGFPIILAGRPPLGFPTSDPTEVFILFSNPSLLFPVSMCSERCSERCSHSPRLPLHPPHFLPPQCVNGVLAPTLSTLSPFPDPKWDLLFPQVVLSRGAAAGPPLVFLLQTGAFWESAGARANRSQREASDASPASHQGELAVCDAVSVWVTDPGTAVDLVVLEVEVLGEVPAAVGSSLHQHFFVAHFEADNSEEGGPGVGGGAAAGVWTGGHWVSECKAKQSYVRALTADAQGRVDWRWIQIGTACVCTLLSRTGRA

SEQ ID NO: 3 - DNA, 1336 bp, Homo sapiens
  CDS (3)..(1325)
caatgaggattgtttgtttagtgaaaaaccaacagcccctgggagccaccatcaagcgccacgagatgacaggggacatcttggtggccaggatcatccacggtgggctggcggagagaagtgggttgctatatgctggagacaaactggtagaagtgaatggagtttcagttgagggactggaccctgaacaagtgatccatattctggccatgtctcgaggcacaatcatgttcaaggtggttccagtctctgaccctcctgtgaatagccagcagatggtaagaattgtgtacgtccgtgccatgactgagtactggccccaggaggatcccgacatcccctgcatggacgctggattgcctttccagaagggggacatcctccagattgtggaccagaatgatgccctctggtggcaggcccgaaaaatctcagaccctgctacctgcgctgggcttgtcccttctaaccaccttctgaagaggaggaagcaacgggaattctggtggtctcagccgtaccagcctcacacctgcctcaagtcaaccctacaactgaaggaggagtttgttggctacggtcagaagttctttataggtaggtctcacctcagcccgctgcatgccagtgtgtgctgcaccggcagctgctacagtgcagtgggtgccccttacgaggaggtggtgaggtaccagcgacgcccttcagacaagtaccgcctcatagtgctcatgggtatgtccttaggaccctctggtgttggagtaaatgagctcagaagacaacttattgaatttaatcccagccattttcaaagtgctgtgccaactactcgtactaaaaagagttacgaaatgaatgggcgtgagtatcactatgtgtccaaggaaacatttgaaaacctcatatatagtcacaggaggatgctggagtatggtgagtacaaaggccacctgtatggcactagtgtggatgctgttcaaacagtccttgtcgaaggaaagatctgtgtcatggacctagagcctcagaatatgaggtgtatgaaacaatctcggaaaaatgccaaggttattactgactactatgtggacatgaagttcaaggtaagagcaagtcaaaaactaaaggatgaagacctacaagagatggaaaatttagcccaaagaatggaaactcagtttggccaattttttgatcatgtgattgtgaatgacagcttgcacgatgcatgtgcccagttgttgtctgccatacagaaggctcaggaggagcctcagtgggtaccagcaacatggatttcctcagatactgagtctcaatgagacttctt

SEQ ID NO: 4 - protein, 441 aa, Homo sapiens
MRIVCLVKNQQPLGATIKRHEMTGDILVARIIHGGLAERSGLLYAGDKLVEVNGVSVEGLDPEQVIHILAMSRGTIMFKVVPVSDPPVNSQQMVRIVYVRAMTEYWPQEDPDIPCMDAGLPFQKGDILQIVDQNDALWWQARKISDPATCAGLVPSNHLLKRRKQREFWWSQPYQPHTCLKSTLQLKEEFVGYGQKFFIGRSHLSPLHASVCCTGSCYSAVGAPYEEVVRYQRRPSDKYRLIVLMGMSLGPSGVGVNELRRQLIEFNPSHFQSAVPTTRTKKSYEMNGREYHYVSKETFENLIYSHRRMLEYGEYKGHLYGTSVDAVQTVLVEGKICVMDLEPQNMRCMKQSRKNAKVITDYYVDMKFKVRASQKLKDEDLQEMENLAQRMETQFGQFFDHVIVNDSLHDACAQLLSAIQKAQEEPQWVPATWISSDTESQ

SEQ ID NO: 5 - DNA, 3089 bp, Homo sapiens
  CDS (48)..(3026)
gctgttctggggagaaattgttgagtgttttccactttaaccttgcaatggaatcagcggggccgcgctctccctgcagccgccaccgcagccgccgcctgggccgctccgtgtccccggtggagccgccgccgccgccgccgggagctcgatgcggacggagcccgggccgagccatggggatcctcagcatcacggaccagccgcccctggtccaggccatctttagccgagatgtggaggaagtgcgttccctactctcgcagaaggagaacatcaatgtgctggaccaagagaggcgaactccattgcatgctgctgcctacgtaggcgatgtccccatcctccagttgctactgatgtcaggtgctaatgtcaatgctaaggacacactgtggctgacccctcttcatcgtgctgctgcctcccgaaacgagacggtgaacctgctcctcaacaagggagccagcctgaatgtctgtgacaaaaaggagcggcagcctctgcattgggcagcttttctagggcacttggaggtcctaaaactgctggtggcacggggagcagacctcggctgcaaggaccgcaagggctatgggctgctccatacagctgctgccagtggccagattgaagtggtgaagtacctgcttcggatgggagcggagatcgatgaacccaatgcttttggaaacacagctttgcacatcgcctgctacctgggccaggatgctgtggctattgagctggtgaatgccggagccaatgtcaaccagccgaatgacaagggcttcacgccactgcatgtggctgcagtctcgaccaatggcgctctctgcttggagctactggttaataatggggctgacgtcaactaccagagcaaagaagggaaaagtcctctgcacatggctgcaatccatggccgtttcacacgctcccagatcctcatccagaatggcagcgagattgattgtgccgacaaatttgggaacacgccactgcatgtggctgctcgatatggacacgagctgctcatcagcaccctcatgaccaatggcgcagataccgcccggcgtggcatccatgacatgttccccctgcacttagctgttctctttggattctctgactgttgtcgtaagcttctttcctcaggtcagttgtacagcattgtgtcttcactcagcaatgagcatgtgctttcagctgggtttgacatcaatacacctgacaaccttggccgtacctgtcttcatgctgctgcttccggagggaatgttgaatgtcttaatttgctgttgagcagtggagctgacttgaggaggagggacaaatttggcaggaccccactgcactatgcagctgctaacggtagctaccagtgtgcagtaacattggtgactgctggggcaggtgtcaacgaggccgactgtaaaggctgctctcccctccactacgctgccgcttctgacacttacaggagagcggaaccccatacaccttccagccatgatgccgaagaggacgagccactgaaggagtcccgcaggaaggaggccttcttctgtctggagttcttactggataacggtgcagacccctccctgcgggacaggcagggctacacagctgtgcactatgcagccgcctatggcaacagacagaacctcgaactgctcttagaaatgtcctttaactgcctggaggatgtggagagcaccattccagtcagccctttgcacttagctgcctacaacggtcactgtgaagccttgaagacgctggcggagacgctggtgaatctggacgtaagggaccacaagggccggaccgcactcttcctggccacggagcgcggctctactgagtgtgtggaggtgcttacagcccacggcgcctctgccctcatcaaggagcgcaagcgcaagtggacacccctgcacgctgctgctgcctctggccacactgactccctgcacttgctgatcgacagtggggaacgagctgacatcacagatgtcatggatgcctatggacagaccccactgatgctggccatcatgaatggccatgtggactgtgtacatctgctgctagagaaaggatccacagctgatgctgctgacctccggggccgcactgccctccaccgcggggcagtgactggctgtgaggactgcctggctgccctgctggaccacgacgcatttgtgctgtgccgagactttaagggccgcacgcccattcacctggcctcagcctgtggccacactgcagtactgcggaccctgctgcaggctgccctttccacagatcccctggatgccggggtggattacagcggatactcgcccatgcactgggcctcctacactggacatgaagattgtctggagttgttacttgaacacagcccgttttcgtacctggaaggaaaccccttcactcctttgcactgtgcagtgattaataaccaagacagcaccacagagatgctactgggagctctgggtgccaagattgtgaacagccgagatgccaaaggacggaccccccttcacgccgctgccttcgcggacaatgtctctgggctccggatgctgctgcagcatcaagctgaggtgaacgccactgaccacattggccgcactgcgctcatgacggcggctgagaacgggcagaccgctgctgtggaatttctgctgtatcgagggaaggcagaccttactgtgttggatgagaacaagaacacggccctccacttggcttgtagcaagggccatgagaaatgtgccctcatgatcctggcagaaacccaagaccttggccttatcaatgctaccaacagtgcgctgcagatgccactccacattgctgcccggaatggtctagcttctgtggtacaggccctgctgagtcatggggccacagtgctggctgtggatgaagaaggtgggtggggtctggggccccatgcctctcttgggtttggggtcagggacattcttcaggaggtgacttcttaatcttgctatacatgggattttcttcccaagggaactcttcagagcagggagcccacacca

SEQ ID NO: 6 - protein, 993 aa, Homo sapiens
MESAGPRSPCSRHRSRRLGRSVSPVEPPPPPPGARCGRSPGRAMGILSITDQPPLVQAIFSRDVEEVRSLLSQKENINVLDQERRTPLHAAAYVGDVPILQLLLMSGANVNAKDTLWLTPLHRAAASRNETVNLLLNKGASLNVCDKKERQPLHWAAFLGHLEVLKLLVARGADLGCKDRKGYGLLHTAAASGQIEVVKYLLRMGAEIDEPNAFGNTALHIACYLGQDAVAIELVNAGANVNQPNDKGFTPLHVAAVSTNGALCLELLVNNGADVNYQSKEGKSPLHMAAIHGRFTRSQILIQNGSEIDCADKFGNTPLHVAARYGHELLISTLMTNGADTARRGIHDMFPLHLAVLFGFSDCCRKLLSSGQLYSIVSSLSNEHVLSAGFDINTPDNLGRTCLHAAASGGNVECLNLLLSSGADLRRRDKFGRTPLHYAAANGSYQCAVTLVTAGAGVNEADCKGCSPLHYAAASDTYRRAEPHTPSSHDAEEDEPLKESRRKEAFFCLEFLLDNGADPSLRDRQGYTAVHYAAAYGNRQNLELLLEMSFNCLEDVESTIPVSPLHLAAYNGHCEALKTLAETLVNLDVRDHKGRTALFLATERGSTECVEVLTAHGASALIKERKRKWTPLHAAAASGHTDSLHLLIDSGERADITDVMDAYGQTPLMLAIMNGHVDCVHLLLEKGSTADAADLRGRTALHRGAVTGCEDCLAALLDHDAFVLCRDFKGRTPIHLASACGHTAVLRTLLQAALSTDPLDAGVDYSGYSPMHWASYTGHEDCLELLLEHSPFSYLEGNPFTPLHCAVINNQDSTTEMLLGALGAKIVNSRDAKGRTPLHAAAFADNVSGLRMLLQHQAEVNATDHIGRTALMTAAENGQTAAVEFLLYRGKADLTVLDENKNTALHLACSKGHEKCALMILAETQDLGLINATNSALQMPLHIAARNGLASVVQALLSHGATVLAVDEEGGWGLGPHASLGFGVRDILQEVTS

SEQ ID NO: 7 - DNA, 3835 bp, Homo sapiens
  CDS (98)..(3688)
cggacagagcctcagacggttgggcggacggacggcccgacaggcgggcatgcgggcggccagactgtagccgagcagcgaggctccggccgcagccatggagcggcggctgcgcgcgctggagcagctggcgcggggcgaggccggcggctgcccggggctcgacggcctcctagatctgctgctggcgctgcaccacgagctcagcagcggccccctacggcgggagcgcagcgtggcgcagttcctgagctgggccagccccttcgtatcaaaggtgaaagaactgcgtctgcagagagatgactttgagatcttgaaggtgatcggccgaggagcctttggggaggtcaccgtggtgaggcagagggacactgggcagatttttgccatgaaaatgctgcacaagtgggagatgctgaagagggctgagacagcctgtttccgggaggagcgggatgtgctcgtgaaaggggacagccgttgggtgaccactctgcactatgccttccaagacgaggagtacctgtaccttgtgatggactactatgctggtggggacctcctgacgctgctgagccgcttcgaggaccgtctcccgcccgagctggcccagttctacctggctgagatggtgctggccatccactcgctgcaccagctgggttatgtccacagggatgtcaagccagacaacgtcctgctggatgtgaacgggcacattcgcctggctgacttcggctcctgcctgcgtctcaacaccaacggcatggtggattcatcagtggcagtagggacgccggactatatctcccctgagatcctgcaggccatggaggagggcaagggccactacggcccacagtgtgactggtggtcgcttggagtctgcgcctatgagctgctctttggggagacgcccttctatgctgagtccttggtggaaacctacggcaagatcatgaaccacgaggaccacctgcagttccccccggacgtgcctgacgtgccagccagcgcccaagacctgatccgccagctgctgtgtcgccaggaagagcggctaggccgtggtgggctggatgacttccggaaccatcctttcttcgaaggcgtggactgggagcggctggcgagcagcacggccccctatattcctgagctgcggggacccatggacacctccaactttgatgtggatgacgacaccctcaaccatccagggaccctgccaccgccctcccacggggccttctccggccatcacctgccattcgtgggcttcacctacacctcagcttgggctgccctggagcggaagctccagtgtctggagcaggagaagctcccagctggaggaagcccgcaactgaggaaggaggtggccgccctgcgagagcagctggagcaggcccacagccacaggcgtctgcaggaggccgagaagcagagccaggccctgcaacaggagctcgccatgctgcgggaggagctggagcaggagagcaagcagcggctggagggtgagcggcgggagacggagagcaactgggaggcccagctcgccgacatcctcagctgggtgaatgatgagaaggtctcaagaggctacctgcaggccctggccaccaagatggcagaggagctggagtccttgaggaacgtaggcacccaggaccaccagtggaaggcgcggcgactgcagaagatggaggcctcggccaggctggagctgcagtcagcgctggaggccgagatccgcgccaagcagggcctgcaggagcggctgacacaggtgcaggaggcccagctgcaggctgagggctgtccccctccccagcccggctcacacacgctgcgcccccggagcttcccatccccgaccaagtgtctccgctgcacctcgctgatgctgggcctgggccgccagggcctgggttgtgattgcggctacttttgtcacacaacctgtgccccacaggccccaccctgccccgtgccccctgacctcctccgcacagccctgggagtacaccccgaaacaggcacaggcactgcctatgagggctttctgtcaggtgtccggcggggctggcagcgcgtgtttgctgccctgagtgactcacgcctgctgctgtttgacgcccctgacctgaggctcagcccgcccagtggggccctcctgcaggtcctagatctgagggacccccagttctcggctacccctgtcctggcctctgatgttatccatgcccaatccagggacctgccacgcatctttagggtgacaacctcccagctggcagtgccgcccaccacgtgcactgtgctgctgctggcagagagcgagggggagcgggaacgctggctgcaggtgctgggtgagctgcagcggctgctgctggacgcgcggccaagaccccggcccgtgtacacactcaaggaggcttacgacaacgggctgccgctgctgcctcacacgctctgcgctgccatcctcgaccaggatcgacttgcgcttggcaccgaggaggggctctttgtcatccatctggacatcttccaggtgggggagtgccggcgcgtgcagcagctgaccttgagccccagtgcaggcctgctggtcgtgctgtgtggccgcggccccagcgtgcgtctctttgccctggcggagctggagaacatagaggtagcaggtgccaagatccccgagtctcgaggctgccaggtgctggcagctggaagcatcctgcaggcccgcaccccggtgctctgtgtagccgtcaagcgccaggtgctctgctaccagctgggcccgggccctgggccctggcagcgccgcatccgtgagctgcaggcacctgccactgtgcagagcctggggctgctgggcgaccggctatgtgtgggcgccgccggtggctttgcactctacccgctgctcaacgaggctgcgccgttggcgctgggggccggtttggtgcctgaggagctgccaccatcccgcgggggcctgggtgaggcactgggtgccgtggagcttagcctcagcgagttcctgctactcttcaccactgctggcatctacgtggatggcgcaggccgcaagtctctgttcagcgagaactccatcgatgtgtttgacgtgaggagggcagaatgggtgcagaccgtgccgctcaagaaggtgcggcccctcaatccagagggctccctgttcctctacggcaccgagaaggacgagttcgacatcccggacctcaccgacaacagccggcgccagctgttccgcaccaagagcaagcgccgcttctttttccgcgtgtcggaggagcagcagaagcagcagcgcagggagatgctgaaggacccttttgtgcgctccaagctcatctcgccgcctaccaacttcaaccacctagtacacgtgggccctgccaacgggcggcccggcgccagggacaagtccccggttagtcctgctccagaatttggaaatcctagtttcctctccttcgtatcccgagtctgggacacaaaactccgcccccagcctatgagcatcctgagccccgccctcttcctgacgaaactggccccggatcagagcaggacctcccttacgccactgcactccagcctggccgacagcaagagtctgtctccctcctccactccccatgagccctaggacgggtcactcatcctctcagagcctcagttcccagccctggagggagatgaggtttcccagccccacagggctgttgtgaggctgacgtgccctcatggccaagggctgtctgtagcctggcccccgtatcctcttggggtt

SEQ ID NO: 8 - protein, 1197 aa, Homo sapiens
MERRLRALEQLARGEAGGCPGLDGLLDLLLALHHELSSGPLRRERSVAQFLSWASPFVSKVKELRLQRDDFEILKVIGRGAFGEVTVVRQRDTGQIFAMKMLHKWEMLKRAETACFREERDVLVKGDSRWVTTLHYAFQDEEYLYLVMDYYAGGDLLTLLSRFEDRLPPELAQFYLAEMVLAIHSLHQLGYVHRDVKPDNVLLDVNGHIRLADFGSCLRLNTNGMVDSSVAVGTPDYISPEILQAMEEGKGHYGPQCDWWSLGVCAYELLFGETPFYAESLVETYGKIMNHEDHLQFPPDVPDVPASAQDLIRQLLCRQEERLGRGGLDDFRNHPFFEGVDWERLASSTAPYIPELRGPMDTSNFDVDDDTLNHPGTLPPPSHGAFSGHHLPFVGFTYTSAWAALERKLQCLEQEKLPAGGSPQLRKEVAALREQLEQAHSHRRLQEAEKQSQALQQELAMLREELEQESKQRLEGERRETESNWEAQLADILSWVNDEKVSRGYLQALATKMAEELESLRNVGTQDHQWKARRLQKMEASARLELQSALEAEIRAKQGLQERLTQVQEAQLQAEGCPPPQPGSHTLRPRSFPSPTKCLRCTSLMLGLGRQGLGCDCGYFCHTTCAPQAPPCPVPPDLLRTALGVHPETGTGTAYEGFLSGVRRGWQRVFAALSDSRLLLFDAPDLRLSPPSGALLQVLDLRDPQFSATPVLASDVIHAQSRDLPRIFRVTTSQLAVPPTTCTVLLLAESEGERERWLQVLGELQRLLLDARPRPRPVYTLKEAYDNGLPLLPHTLCAAILDQDRLALGTEEGLFVIHLDIFQVGECRRVQQLTLSPSAGLLVVLCGRGPSVRLFALAELENIEVAGAKIPESRGCQVLAAGSILQARTPVLCVAVKRQVLCYQLGPGPGPWQRRIRELQAPATVQSLGLLGDRLCVGAAGGFALYPLLNEAAPLALGAGLVPEELPPSRGGLGEALGAVELSLSEFLLLFTTAGIYVDGAGRKSLFSENSIDVFDVRRAEWVQTVPLKKVRPLNPEGSLFLYGTEKDEFDIPDLTDNSRRQLFRTKSKRRFFFRVSEEQQKQQRREMLKDPFVRSKLISPPTNFNHLVHVGPANGRPGARDKSPVSPAPEFGNPSFLSFVSRVWDTKLRPQPMSILSPALFLTKLAPDQSRTSLTPLHSSLADSKSLSPSSTPHEP

SEQ ID NO: 9 - DNA, 3985 bp, Homo sapiens
  CDS (98)..(3838)
cggacagagcctcagacggttgggcggacggacggcccgacaggcgggcatgcgggcggccagactgtagccgagcagcgaggctccggccgcagccatggagcggcggctgcgcgcgctggagcagctggcgcggggcgaggccggcggctgcccggggctcgacggcctcctagatctgctgctggcgctgcaccacgagctcagcagcggccccctacggcgggagcgcagcgtggcgcagttcctgagctgggccagccccttcgtatcaaaggtgaaagaactgcgtctgcagagagatgactttgagatcttgaaggtgatcggccgaggagcctttggggaggtcaccgtggtgaggcagagggacactgggcagatttttgccatgaaaatgctgcacaagtgggagatgctgaagagggctgagacagcctgtttccgggaggagcgggatgtgctcgtgaaaggggacagccgttgggtgaccactctgcactatgccttccaagacgaggagtacctgtaccttgtgatggactactatgctggtggggacctcctgacgctgctgagccgcttcgaggaccgtctcccgcccgagctggcccagttctacctggctgagatggtgctggccatccactcgctgcaccagctgggttatgtccacagggatgtcaagccagacaacgtcctgctggatgtgaacgggcacattcgcctggctgacttcggctcctgcctgcgtctcaacaccaacggcatggtggattcatcagtggcagtagggacgccggactatatctcccctgagatcctgcaggccatggaggagggcaagggccactacggcccacagtgtgactggtggtcgcttggagtctgcgcctatgagctgctctttggggagacgcccttctatgctgagtccttggtggaaacctacggcaagatcatgaaccacgaggaccacctgcagttccccccggacgtgcctgacgtgccagccagcgcccaagacctgatccgccagctgctgtgtcgccaggaagagcggctaggccgtggtgggctggatgacttccggaaccatcctttcttcgaaggcgtggactgggagcggctggcgagcagcacggccccctatattcctgagctgcggggacccatggacacctccaactttgatgtggatgacgacaccctcaaccatccagggaccctgccaccgccctcccacggggccttctccggccatcacctgccattcgtgggcttcacctacacctcagcttgggctgccctggagcggaagctccagtgtctggagcaggagaagctcccagctggaggaagcccgcaactgaggaaggaggtggccgccctgcgagagcagctggagcaggcccacagccacaggcgtctgcaggaggccgagaagcagagccaggccctgcaacaggagctcgccatgctgcgggaggagctggagcaggagagcaagcagcggctggagggtgagcggcgggagacggagagcaactgggaggcccagctcgccgacatcctcagctgggtgaatgatgagaaggtctcaagaggctacctgcaggccctggccaccaagatggcagaggagctggagtccttgaggaacgtaggcacccaggaccaccagtggaaggcgcggcgactgcagaagatggaggcctcggccaggctggagctgcagtcagcgctggaggccgagatccgcgccaagcagggcctgcaggagcggctgacacaggtgcaggaggcccagctgcaggctgagggctgtccccctccccagcccggctcacacacgctgcgcccccggagcttcccatccccgaccaagtgtctccgctgcacctcgctgatgctgggcctgggccgccagggcctgggttgtgattgcggctacttttgtcacacaacctgtgccccacaggccccaccctgccccgtgccccctgacctcctccgcacagccctgggagtacaccccgaaacaggcacaggcactgcctatgagggctttctgtcaggtgtccggcggggctggcagcgcgtgtttgctgccctgagtgactcacgcctgctgctgtttgacgcccctgacctgaggctcagcccgcccagtggggccctcctgcaggtcctagatctgagggacccccagttctcggctacccctgtcctggcctctgatgttatccatgcccaatccagggacctgccacgcatctttagggtgagtgcctggtcccagctggcagtgccgcccaccacgtgcactgtgctgctgctggcagagagcgagggggagcgggaacgctggctgcaggtgctgggtgagctgcagcggctgctgctggacgcgcggccaagaccccggcccgtgtacacactcaaggaggcttacgacaacgggctgccgctgctgcctcacacgctctgcgctgccatcctcgaccaggatcgacttgcgcttggcaccgaggaggggctctttgtcatccatctggacatcttccaggtgggggagtgccggcgcgtgcagcagctgaccttgagccccagtgcaggcctgctggtcgtgctgtgtggccgcggccccagcgtgcgtctctttgccctggcggagctggagaacatagaggtagcaggtgccaagatccccgagtctcgaggctgccaggtgctggcagctggaagcatcctgcaggcccgcaccccggtgctctgtgtagccgtcaagcgccaggtgctctgctaccagctgggcccgggccctgggccctggcagcgccgcatccgtgagctgcaggcacctgccactgtgcagagcctggggctgctgggcgaccggctatgtgtgggcgccgccggtggctttgcactctacccgctgctcaacgaggctgcgccgttggcgctgggggccggtttggtgcctgaggagctgccaccatcccgcgggggcctgggtgaggcactgggtgccgtggagcttagcctcagcgagttcctgctactcttcaccactgctggcatctacgtggatggcgcaggccgcaagtctcgtggccacgagctgttgtggccagcagcgccccctggcgtgcccgcagggtatgcggccccctacctgacagtgttcagcgagaactccatcgatgtgtttgacgtgaggagggcagaatgggtgcagaccgtgccgctcaagaaggtgagggtccgccagagccctgggctgcctcaggtgcggcccctcaatccagagggctccctgttcctctacggcaccgagaaggtccgcctgacctacctcaggaaccagctggcaggtgagggagacgagttcgacatcccggacctcaccgacaacagccggcgccagctgttccgcaccaagagcaagcgccgcttctttttccgcgtgtcggaggagcagcagaagcagcagcgcagggagatgctgaaggacccttttgtgcgctccaagctcatctcgccgcctaccaacttcaaccacctagtacacgtgggccctgccaacgggcggcccggcgccagggacaagtccccggttagtcctgctccagaatttggaaatcctagtttcctctccttcgtatcccgagtctgggacacaaaactccgcccccagcctatgagcatcctgagccccgccctcttcctgacgaaactggccccggatcagagcaggacctcccttacgccactgcactccagcctggccgacagcaagagtctgtctccctcctccactccccatgagccctaggacgggtcactcatcctctcagagcctcagttcccagccctggagggagatgaggtttcccagccccacagggctgttgtgaggctgacgtgccctcatggccaagggctgtctgtagcctggcccccgtatcctcttggggtt

SEQ ID NO: 10 - protein, 1247 aa, Homo sapiens
MERRLRALEQLARGEAGGCPGLDGLLDLLLALHHELSSGPLRRERSVAQFLSWASPFVSKVKELRLQRDDFEILKVIGRGAFGEVTVVRQRDTGQIFAMKMLHKWEMLKRAETACFREERDVLVKGDSRWVTTLHYAFQDEEYLYLVMDYYAGGDLLTLLSRFEDRLPPELAQFYLAEMVLAIHSLHQLGYVHRDVKPDNVLLDVNGHIRLADFGSCLRLNTNGMVDSSVAVGTPDYISPEILQAMEEGKGHYGPQCDWWSLGVCAYELLFGETPFYAESLVETYGKIMNHEDHLQFPPDVPDVPASAQDLIRQLLCRQEERLGRGGLDDFRNHPFFEGVDWERLASSTAPYIPELRGPMDTSNFDVDDDTLNHPGTLPPPSHGAFSGHHLPFVGFTYTSAWAALERKLQCLEQEKLPAGGSPQLRKEVAALREQLEQAHSHRRLQEAEKQSQALQQELAMLREELEQESKQRLEGERRETESNWEAQLADILSWVNDEKVSRGYLQALATKMAEELESLRNVGTQDHQWKARRLQKMEASARLELQSALEAEIRAKQGLQERLTQVQEAQLQAEGCPPPQPGSHTLRPRSFPSPTKCLRCTSLMLGLGRQGLGCDCGYFCHTTCAPQAPPCPVPPDLLRTALGVHPETGTGTAYEGFLSGVRRGWQRVFAALSDSRLLLFDAPDLRLSPPSGALLQVLDLRDPQFSATPVLASDVIHAQSRDLPRIFRVSAWSQLAVPPTTCTVLLLAESEGERERWLQVLGELQRLLLDARPRPRPVYTLKEAYDNGLPLLPHTLCAAILDQDRLALGTEEGLFVIHLDIFQVGECRRVQQLTLSPSAGLLVVLCGRGPSVRLFALAELENIEVAGAKIPESRGCQVLAAGSILQARTPVLCVAVKRQVLCYQLGPGPGPWQRRIRELQAPATVQSLGLLGDRLCVGAAGGFALYPLLNEAAPLALGAGLVPEELPPSRGGLGEALGAVELSLSEFLLLFTTAGIYVDGAGRKSRGHELLWPAAPPGVPAGYAAPYLTVFSENSIDVFDVRRAEWVQTVPLKKVRVRQSPGLPQVRPLNPEGSLFLYGTEKVRLTYLRNQLAGEGDEFDIPDLTDNSRRQLFRTKSKRRFFFRVSEEQQKQQRREMLKDPFVRSKLISPPTNFNHLVHVGPANGRPGARDKSPVSPAPEFGNPSFLSFVSRVWDTKLRPQPMSILSPALFLTKLAPDQSRTSLTPLHSSLADSKSLSPSSTPHEP

SEQ ID NO: 11 - DNA, 332 bp, Homo sapiens
  CDS (8)..(319)
ctccaacatggcaaaaatctccagccctacagagactgtgcggtgcattcagtccctgattgctgttttccagaagtatgctggaaaggatggttacaaccgcaatctctccaagacggagttcctaagcttcatgaatacagagctggctgcctttacaaagaaccagaaggaccccggtgtccttgaccgcatgaagaaactggatgtcagcagcgatgggcagttagatttcccaaaatttcttaatctgattggcggcctagctgtggcttgccatgactccttcctcaaggctgtcccttcccagaagtggaactgaggaccccatg

SEQ ID NO: 12 - protein, 104 aa, Homo sapiens
MAKISSPTETVRCIQSLIAVFQKYAGKDGYNRNLSKTEFLSFMNTELAAFTKNQKDPGVLDRMKKLDVSSDGQLDFPKFLNLIGGLAVACHDSFLKAVPSQKWN

SEQ ID NO: 13 - DNA, 1121 bp, Homo sapiens
  CDS (30)..(1118)
ttatttcaaaaactttcgatactgctcctatggctccccatgtccgaatatgtatgcccttgacggacggcatttcttcatttgaggacctcttggctaacaatatcctcagaatatttgtctgggttatagctttcattacctgctttggaaatctttttgtcattggcatgagatctttcattaaagctgaaaatacaactcacgctatgtccatcaaaatcctttgttgtgctgattgcctgatgggtgtttacttgttctttgttggcattttcgatataaaataccgagggcagtatcagaagtatgccttgctgtggatggagagcgtgcagtgccgcctcatggggttcctggccatgctgtccaccgaagtctctgttctgctactgacctacttgactttggagaagttcctggtcattgtcttccccttcagtaacattcgacctggaaaacggcagacctcagtcatcctcatttgcatctggatggcgggatttttaatagctgtaattccattttggaataaggattattttggaaacttttatgggaaaaatggagtatgtttcccactttattatgaccaaacagaagatattggaagcaaagggtattctcttggaattttcctaggtgtgaacttgctggcttttctcgtcattgtgttttcctatattactatgttctgttccattcaaaaaaccgccttgcagaccacagaagtaaggaattgttttggaagagaggtggctgttgcaaatcgtttcttttttatagtgttctctgatgccatctgctggattcctgtatttgtagttaaaatcctttccctcttccgggtggaaattccagacacaatgacttcctggatagtgatttttttccttccagttaacagtgctttgaatccaatcctctatactctcacaaccaacttttttaaggacaagttgaaacagctgctgcacaaacatcagaggaaatcaattttcaaaattaaaaaaaaaagtttatctacatccattgtgtggatagaggactcctcttccctgaaacttggggttttgaacaaaataacacttggagacagtataatgaaaccagtttcctag

SEQ ID NO: 14 - protein, 363 aa, Homo sapiens
MAPHVRICMPLTDGISSFEDLLANNILRIFVWVIAFITCFGNLFVIGMRSFIKAENTTHAMSIKILCCADCLMGVYLFFVGIFDIKYRGQYQKYALLWMESVQCRLMGFLAMLSTEVSVLLLTYLTLEKFLVIVFPFSNIRPGKRQTSVILICIWMAGFLIAVIPFWNKDYFGNFYGKNGVCFPLYYDQTEDIGSKGYSLGIFLGVNLLAFLVIVFSYITMFCSIQKTALQTTEVRNCFGREVAVANRFFFIVFSDAICWIPVFVVKILSLFRVEIPDTMTSWIVIFFLPVNSALNPILYTLTTNFFKDKLKQLLHKHQRKSIFKIKKKSLSTSIVWIEDSSSLKLGVLNKITLGDSIMKPVS

SEQ ID NO: 15 - DNA, 828 bp, Homo sapiens
  CDS (16)..(801)
ccaccccgagggaccatgtcgaggctcagctggggataccgcgagcacaacggtcctattcactggaaggaatttttccctattgctgatggtgatcagcaatctccaattgagattaaaaccaaagaagtgaaatatgactcttccctccgaccacttagtatcaagtatgacccaagctcagctaaaatcatcagcaacagcggccattccttcaatgttgactttgatgacacagagaacaaatcagttctgcgtggtggtcctctcactggaagctacaggttacggcaggttcaccttcactgggggtccgctgatgaccacggctccgagcacatagtagatggagtgagctatgctgcagagctccatgttgttcactggaattcagacaaataccccagctttgttgaggcagctcatgaaccagatggactggctgtcttgggagtgtttttacaggtgggtgaacctaattcccaactgcaaaagattactgacactttggattccattaaagaaaagggtaaacaaactcgattcacaaattttgacctattgtctctgcttccaccatcctgggactactggacatatcctggttctcttacagttccacctcttcttgagagtgtcacatggattgttttaaagcaacctataaacatcagctctcaacagctggccaaatttcgcagtctcctgtgcacagcggagggtgaagcagcagcttttctggtgagcaatcaccgcccaccacagcctctaaagggccgcaaagtgagagcctctttccattaaaaattgtcaccaatgaactccccc

SEQ ID NO: 16 - protein, 262 aa, Homo sapiens
MSRLSWGYREHNGPIHWKEFFPIADGDQQSPIEIKTKEVKYDSSLRPLSIKYDPSSAKIISNSGHSFNVDFDDTENKSVLRGGPLTGSYRLRQVHLHWGSADDHGSEHIVDGVSYAAELHVVHWNSDKYPSFVEAAHEPDGLAVLGVFLQVGEPNSQLQKITDTLDSIKEKGKQTRFTNFDLLSLLPPSWDYWTYPGSLTVPPLLESVTWIVLKQPINISSQQLAKFRSLLCTAEGEAAAFLVSNHRPPQPLKGRKVRASFH

SEQ ID NO: 17 - DNA, 833 bp, Homo sapiens
  CDS (21)..(806)
atgtcgaggctcagctggggatgtcgaggctcagctggggataccgcgagcacaacggtcctattcactggaaggaatttttccctattgctgatggtgatcagcaatctccaattgagattaaaaccaaagaagtgaaatatgactcttccctccgaccacttagtatcaagtatgacccaagctcagctaaaatcatcagcaacagcggccattccttcaatgttgactttgatgacacagagaacaaatcagttctgcgtggtggtcctctcactggaagctacaggttacggcaggttcaccttcactgggggtccgctgatgaccacggctccgagcacatagtagatggagtgagctatgctgcagagctccatgttgttcactggaattcagacaaataccccagctttgttgaggcagctcatgaaccagatggactggctgtcttgggagtgtttttacagattggtgaacctaattcccaactgcaaaagattactgacactttggattccattaaagaaaagggtaaacaaactcgattcacaaattttgacctattgtctctgcttccaccatcctgggactactggacatatcctggttctcttacagttccacctcttcttgagagtgtcacatggattgttttaaagcaacctataaacatcagctctcaacagctggccaaatttcgcagtctcctgtgcacagcggagggtgaagcagcagcttttctggtgagcaatcaccgcccaccacagcctctaaagggccgcaaagtgagagcctctttccattaaaaattgtcaccaatgaactccccc

SEQ ID NO: 18 - protein, 262 aa, Homo sapiens
MSRLSWGYREHNGPIHWKEFFPIADGDQQSPIEIKTKEVKYDSSLRPLSIKYDPSSAKIISNSGHSFNVDFDDTENKSVLRGGPLTGSYRLRQVHLHWGSADDHGSEHIVDGVSYAAELHVVHWNSDKYPSFVEAAHEPDGLAVLGVFLQIGEPNSQLQKITDTLDSIKEKGKQTRFTNFDLLSLLPPSWDYWTYPGSLTVPPLLESVTWIVLKQPINISSQQLAKFRSLLCTAEGEAAAFLVSNHRPPQPLKGRKVRASFH

SEQ ID NO: 19 - DNA, 1196 bp, Homo sapiens
  CDS (16)..(1137)
ttactgtgtggcagaatgaagcctctgcttgaaaccctttatcttttggggatgctggttcctggagggctgggatatgatagatccttagcccaacacagacaagagattgtggacaagtcagtgagtccatggagcctggagacgtattcctataacatataccaccccatgggagagatcaatgagtggatgagagagatcagtgagaagtacaaggaagtggtgacacagcatttcctaggagtgacctatgagacccaccccatatattatctgaagatcagccaaccatctggtaatcccaagaaaatcatttggatgggctgtggaattcacgccagagaatggattgctcctgctttttgccaatggttcgtcaaagaaattctacaaaaccataaagacaactcaaggatacgcaagctccttaggaacctggacttctatgtccttccagttcttaacatagatggttatatctacacttggacaactgatcgtctttggaggaaatcccgttcaccccataataatggcacatgttttgggacggatctcaatcgaaatttcaatgcatcttggtgtagtattggtgcctctagaaactgccaagatcaaacattctgtgggacagggccagtgtctgaaccagagactaaagctgttgccagcttcatagagagcaagaaggatgatattttgtgcttcctgaccatgcactcttatgggcagttaattctcacaccttacggctacaccaaaaataaatcaagtaaccacccagaaatgattcaagttggacagaaggcagcaaatgcattgaaagcaaagtatggaaccaattatagagttggatcgagtgcagatattttatatgcctcatcagggtcttcaagagattgggcccgagacattgggattcccttctcatatacgtttgagctgagggacagtggaacatatgggtttgttctgccagaagctcagatccagcccacctgtgaggagaccatggaggctgtgctgtcagtcctggatgatgtgtatgcgaaacactggcactcggacagtgctggaagggtgacatctgccactatgctgctgggcctgctggtgtcctgcatgtctcttctctaagtgcatcctgcccaggcctgctcaaccccagtggcatgagtgtggctggaggaacg

SEQ ID NO: 20 - protein, 374 aa, Homo sapiens
MKPLLETLYLLGMLVPGGLGYDRSLAQHRQEIVDKSVSPWSLETYSYNIYHPMGEINEWMREISEKYKEVVTQHFLGVTYETHPIYYLKISQPSGNPKKIIWMGCGIHAREWIAPAFCQWFVKEILQNHKDNSRIRKLLRNLDFYVLPVLNIDGYIYTWTTDRLWRKSRSPHNNGTCFGTDLNRNFNASWCSIGASRNCQDQTFCGTGPVSEPETKAVASFIESKKDDILCFLTMHSYGQLILTPYGYTKNKSSNHPEMIQVGQKAANALKAKYGTNYRVGSSADILYASSGSSRDWARDIGIPFSYTFELRDSGTYGFVLPEAQIQPTCEETMEAVLSVLDDVYAKHWHSDSAGRVTSATMLLGLLVSCMSLL

SEQ ID NO: 21 - DNA, 1222 bp, Homo sapiens
  CDS (41)..(1162)
ccagagaggcccagaattttctaacttactgtgtggcagaatgaagcctctgcttgaaaccctttatcttttggggatgctggttcctggagggctgggatatgatagatccttagcccaacacagacaagagattgtggacaagtcagtgagtccatggagcctggagacgtattcctataacatataccaccccatgggagagatctatgagtggatgagagagatcagtgagaagtacaaggaagtggtgacacagcatttcctaggagtgacctatgagacccaccccatatattatctgaagatcagccaaccatctggtaatcccaagaaaatcatttggatggactgtggaattcacgccagagaatggattgctcctgctttttgccaatggttcgtcaaagaaattctacaaaaccataaagacaactcaaggatacgcaagctccttaggaacctggacttctatgtccttccagttcttaacatagatggttatatctacacttggacaactgatcgtctttggaggaaatcccgttcaccccataataatggcacatgttttgggacggatctcaatcgaaatttcaatgcttcttggtgtagtattggtgcctctagaaactgccaagatcaaacattctgtgggacagggccagtgtctgaaccagagactaaagctgttgccagcttcatagagagcaagaaggatgatattttgtgcttcctgaccatgcactcttatgggcagttaattctcacaccttacggctacaccaaaaataaatcaagtaaccacccagaaatgattcaagttggacagaaggcagcaaatgcattgaaagcaaagtatggaaccaattatagagttggatcgagtgcagatattttatatgcctcatcagggtcttcaagagattgggcccgagacattgggattcccttctcatatacgtttgagctgagggacagtggaacatatgggtttgttctgccagaagctcagatccagcccacctgtgaggagaccatggaggctgtgctgtcagtcctggatgatgtgtatgcgaaacactggcactcggacagtgctggaagggtgacatctgccactatgctgctgggcctgctggtgtcctgcatgtctcttctctaagtgcattctgcccaggcctgctcaaccccagtggcatgagtgtggcttggaggaacg

SEQ ID NO: 22 - protein, 374 aa, Homo sapiens [sequence omitted]

SEQ ID NO: 23 - DNA, 977 bp, Homo sapiens
  CDS (41)..(670)
ccagagaggcccagaattttctaacttactgtgtggcagaatgaagcctctgcttgaaaccctttatcttttggggatgctggttcctggagggctgggatatgatagatccttagcccaacacagacaagagattgtggacaagtcagtgagtccatggagcctggaaacgtattcctataacatataccaccccatgggagagatctatgagtggatgagagagatcagtgagaagtacaaggaagtggtgacacagcatttcctaggagtgacctatgagacccaccccatatattatctgaagatcagccaaccatctggtaatcccaagaaaatcatttggatggactgtggaattcacgccagagaatggattgctcctgctttttgccaatggttcgtcaaagaaattctacaaaaccataaagacaactcaaggatacgcaagctccttaggaacctggacttctatgtccttccagttcttaacatagatggttatatctacacttggacaactgatcgtctttggaggaaatcccgttcaccccataataatggcacatgttttgggacggatctcaatcgaaatttcaatgcttcttggtgtaattcaagttggacagaaggcagcaaatgcattgaaagcaaagtatggaaccaattatagagttggatcgagtgcagatattttatatgcctcatcagggtcttcaagagattgggcccgagacattgggattcccttctcatatacgtttgagctgagggacagtggaacatatgggtttgttctgccagaagctcagatccagcccacctgtgaggagaccatggaggctgtgctgtcagtcctggatgatgtgtatgcgaaacactggcactcggacagtgctggaagggtgacatctgccactatgctgctgggcctgctggtgtcctgcatgtctcttctctaagtgcatcctgcccag

SEQ ID NO: 24 - protein, 210 aa, Homo sapiens
MKPLLETLYLLGMLVPGGLGYDRSLAQHRQEIVDKSVSPWSLETYSYNIYHPMGEIYEWMREISEKYKEVVTQHFLGVTYETHPIYYLKISQPSGNPKKIIWMDCGIHAREWIAPAFCQWFVKEILQNHKDNSRIRKLLRNLDFYVLPVLNIDGYIYTWTTDRLWRKSRSPHNNGTCFGTDLNRNFNASWCNSSWTEGSKCIESKVWNQL

SEQ ID NO: 25 - DNA, 1378 bp, Homo sapiens
  CDS (259)..(1224)
actcactatagggctcgagcggccgcccgggcaggtgaaaatacatcagcatgtgggaaagagcaacgttgatcgtcttcacggaaaggctgaggaccctgcgcctaccacatgttggccagggtgagcaagcagtgaaagagaaaacacttttttcaaaaagccaactgatccttagcccaacacagacaagagattgtggacaagtcagtgagtccatggagcctggagacgtattcctataacatataccaccccatgggagagatctatgagtggatgagagagatcagtgagaagtacaaggaagtggtgacacagcatttcctaggagtgacctatgagacccaccccatatattatctgaagatcagccaaccatctggtaatcccaagaaaatcatttggatggactgtggaattcacgccagagaatggattgctcctgctttttgccaatggttcgtcaaagaaattctacaaaaccataaagacaactcaaggatacgcaagctccttaggaacctggacttctatgtccttccagttcttaacatagatggttatatctacacttggacaactgatcgtctttggaggaaatcccgttcaccccataataatggcacatgttttgggacggatctcaatcgaaatttcaatgcttcttggtgtagtattggtgcctctagaaactgccaagatcaaacattctgtgggacagggccagtgtctgaaccagagactaaagctgttgccagcttcatagagagcaagaaggatgatattttgtgcttcctgaccatgcactcttatgggcagttaattctcacaccttacggctacaccaaaaataaatcaagtaaccacccagaaatgattcaagttggacagaaggcagcaaatgcattgaaagcaaagtatggaaccaattatagagttggatcgagtgcagatattttatatgcctcatcagggtcttcaagagattgggcccgagacattgggattcccttctcatatacgtttgagctgagggacagtggaacatatgggtttgttctgccagaagctcagatccagcccacctgtgaggagaccatggaggctgtgctgtcagtcctggatgatgtgtatgcgaaacactggcactcggacagtgctggaagggtgacatctgccactatgctgctgggcctgctggtgtcctgcatgtctcttctctaagtgcattctgcccaggcctgctcaaccccagtggcatgagtgtggctggaggaacggtgtgttatggttgtaaagaaaccaaataatttaactaaaaatacttcctatttcaataaaaaaaaaaaaaaaaaaaaaaaaaaaaaaaaaaaaa

SEQ ID NO: 26 - protein, 322 aa, Homo sapiens [sequence omitted]

SEQ ID NO: 27 - DNA, 1142 bp, Homo sapiens
  CDS (3)..(1019)
aggctgtggagctgtgttacaagaacgtgaacgaatcctgcattaaaactccttactcgccaggtcctcgatctatcctctacgccgtccttggttttggggctgtgctggcagcgtttggaaacttactggtcatgattgctatccttcacttcaaacaactgcacacacctacaaactttctgattgcgtcgctggcctgtgctgacttcttggtgggagtcactgtgatgcccttcagcacagtgaggtctgtggagagctgttggtactttggggacagttactgtaaattccatacatgttttgacacatccttctgttttgcttctttatttcatttatgctgtatctctgttgatagatacattgctgttactgatcctctgacctatccaaccaagtttactgtgtcagtttcagggatatgcattgttctttcctggttcttttctgtcacatacagcttttcgatcttttacacgggagccaacgaagaaggaattgaggaattagtagttgctctaacctgtgtaggaggctgccaggctccactgaatcaaaactgggtcctactttgttttcttctattctttatacccaatgtcgccatggtgtttatatacagtaagatatttttggtggccaagcatcaggctaggaagatagaaagtacagccagccaagctcagtcctcctcagagagttacaaggaaagagtagcaaaaagagagagaaaggctgccaaaactttgggaattgctatggcagcatttcttgtctcttggctaccatacctcgttgatgcagtgattgatgcttatatgaattttataactcctccttatgtttatgagattttagtttggtgtgtttattataattcagctatgaaccccttgatttatgctttcttttaccaatggtttgggaaggcaataaaacttattgtaagcggcaaggtcttaaggactgattcgtcaacaactaatttattttctgaagaagtagagacagattaaaaacattactgtagagacctcaaaactaacttgaaattaaggtcaagtgcaaaaataaacacttggacatagagaggcaagcatgatcatatgccaagttgtaggacaatacattcaatc

SEQ ID NO: 28 - protein, 339 aa, Homo sapiens
AVELCYKNVNESCIKTPYSPGPRSILYAVLGFGAVLAAFGNLLVMIAILHFKQLHTPTNFLIASLACADFLVGVTVMPFSTVRSVESCWYFGDSYCKFHTCFDTSFCFASLFHLCCISVDRYIAVTDPLTYPTKFTVSVSGICIVLSWFFSVTYSFSIFYTGANEEGIEELVVALTCVGGCQAPLNQNWVLLCFLLFFIPNVAMVFIYSKIFLVAKHQARKIESTASQAQSSSESYKERVAKRERKAAKTLGIAMAAFLVSWLPYLVDAVIDAYMNFITPPYVYEILVWCVYYNSAMNPLIYAFFYQWFGKAIKLIVSGKVLRTDSSTTNLFSEEVETD

SEQ ID NO: 29 - DNA, 1189 bp, Homo sapiens
  CDS (85)..(1143)
gggagcaggggggggagaggcctgcagctcccccaccactcccacgccgcccgtcggggcgcggccgggcgcgggccccgggcgatggccgcggagctggcgatgggcgccgagctgcccagcagcccgctggccatcgagtacgtcaacgacttcgacctgatgaagttcgaggtgaagaaggagcctcccgaggccgagcgcttctgccaccgcctgccgccaggctcgctgtcctcgacgccgctcagcacgccctgctcctccgtgccctcctcgcccagcttctgcgcgcccagcccgggcaccggcggcggcggcggcgcggggggcggcggcggctcgtctcaggccgggggcgcccccgggccgccgagcgggggccccggcgccgtcgggggcacctcggggaagccggcgctggaggatctgtactggatgagcggctaccagcatcacctcaaccccgaggcgctcaacctgacgcccgaggacgcggtggaggcgctcatcggcagcggccaccacggcgcgcaccacggcgcgcaccacccggcggccgccgcagcctacgaggctttccgcggcccgggcttcgcgggcggcggcggagcggacgacatgggcgccggccaccaccacggcgcgcaccacgccgcccaccatcaccacgccgcccaccaccaccaccaccaccaccaccaccatggcggcgcgggacacggcggtggcgcgggccaccacgtgcgcctggaggagcgcttctccgacgaccagctggtgtccatgtcggtgcgcgagctgaaccggcagctccgcggcttcagcaaggaggaggtcatccggctcaagcagaagcggcgcacgctcaagaaccgcggctacgcgcagtcctgccgcttcaagcgggtgcagcagcggcacattctggagagcgagaagtgccaactccagagccaggtggagcagctgaagctggaggtggggcgcctggccaaagagcgggacctgtacaaggagaaatacgagaagctggcgggccggggcggccccgggagcgcgggcggggccggtttcccgcgggagccttcgccgccgcaggccggtcccggcggggccaagggcacggccgacttcttcctgtaggcgccggaccccgagcccgcgccgccgtcgccggggacaagtt

SEQ ID NO: 30 - protein, 353 aa, Homo sapiens
MAAELAMGAELPSSPLAIEYVNDFDLMKFEVKKEPPEAERFCHRLPPGSLSSTPLSTPCSSVPSSPSFCAPSPGTGGGGGAGGGGGSSQAGGAPGPPSGGPGAVGGTSGKPALEDLYWMSGYQHHLNPEALNLTPEDAVEALIGSGHHGAHHGAHHPAAAAAYEAFRGPGFAGGGGADDMGAGHHHGAHHAAHHHHAAHHHHHHHHHHGGAGHGGGAGHHVRLEERFSDDQLVSMSVRELNRQLRGFSKEEVIRLKQKRRTLKNRGYAQSCRFKRVQQRHILESEKCQLQSQVEQLKLEVGRLAKERDLYKEKYEKLAGRGGPGSAGGAGFPREPSPPQAGPGGAKGTADFFL

SEQ ID NO: 31 - DNA, 2599 bp, Homo sapiens
  CDS (78)..(2567)
ccgccgcggcgcccgcccagccccggactgtccgcgctccatctggtatcttggcctcagctgtccttgaagtcaccatggcgtggtccccaccagccaccctctttctgttcctgctgctgctaggccagccccctcccagcaggccacagtcactgggcaccactaagctccggctggtgggcccagagagcaagccagaggagggccgcctggaggtgctgcaccagggccagtggggcaccgtgtgtgatgacaactttgctatccaggaggccacagtggcttgccgccagctgggcttcgaagctgccttgacctgggcccacagtgccaagtacggccaaggggagggacccatctggctggacaatgtgcgctgtgtgggcacagagagctccttggaccagtgcgggtctaatggctggggagtcagtgactgcagtcactcagaagacgtaggggtgatatgccacccccggcgccatcgtggctacctttctgaaactgtctccaatgcccttgggccccaggtgaggaggctgggccggcggctggaggaggtgcggctcaagcccatccttgccagtgccaagcagcatagcccagtgaccgagggagccgtggaggtgaagtatgagggccactggcggcaggtgtgtgaccagggctggaccatgaacaacagcagggtggtgtgcgggatgctgggcttccccagcgaggtgcctgtcgacagccactactacaggctgaagagcctgacgaataagaactccttctggatccaccaggtcacctgcctggggacagagccccacatggccaactgccaggtgcaggtggctccagcccggggcaagctgcggccagcctgcccaggtggcatgcacgctgtggtcagctgtgtggcagggcctcacttccgcccaccgaagacaaagccacaacgcaaagggtcctgggcagaggagccgagggtgcgcctgcgctccggggcccaggtgggcgagggccgggtggaagtgctcatgaaccgccagtggggcacggtctgtgaccacaggtggaacctcatctctgccagtgtcgtgtgtcgtcagctgggctttggctctgctcgggaggccctctttggggcccggctgggccaagggctagggcccatccacctgagtgaggtgcgctgcaggggatatgagcggaccctcagcgactgccctgccctggaagggtcccagaatggttgccaacatgagaatgatgctgctgtcaggtgcaatgtccctaacatgggctttcagaatcaggtgcgcttggctggtgggcgtatccctgaggaggggctattggaggtgcaggtggaggtgaacggggtcccacgctgggggagcgtgtgcagtgaaaactgggggctcaccgaagccatggtggcctgccgacagctcggcctgggttttgccatccatgcctacaaggaaacctggttctggtcggggacgccaagggcccaggaggtggtgatgagtggggtgcgctgctcaggcacagagctggccctgcagcagtgccagaggcacgggccggtgcactgctcccacggtggcgggcgcttcctggctggagtctcctgcatggacagtgcaccagacctggtgatgaacgcccagctagtgcaggagacggcctacttggaggaccgcccgctcagccagctgtattgtgcccacgaggagaactgcctctccaagtctgcggatcacatggactggccctacggataccgccgcctattgcgcttctccacacagatctacaatctgggccggactgactttcgtccaaagactggacgcgatagctgggtttggcaccagtgccacaggcattaccacagcattgaggtcttcacccactacgacctcctcactctcaatggctccaaggtggctgaggggcacaaggccagcttctgtctggaggacacaaactgccccacaggactgcagcggcgctacgcatgtgccaactttggagaacagggagtgactgtaggctgctgggacacctaccggcatgacattgattgccagtgggtggatatcacagatgtgggccccgggaattatatcttccaggtgattgtgaacccccactatgaagtggcagagtcagatttctccaacaatatgctgcagtgccgctgcaagtatgatgggcaccgggtctggctgcacaactgccacacaggtgaattcatacccagccaatgcagaactctccctggagcaggaacagcgtctcaggaacaacctcatctgaagctgtcactgcacactcctagctgctgccgatacaccagatacctcagcttattggagccatgcccttcacagagtcccaactcagaggaaaagggccagtgccaaggggcaccaagaacctgctcaggaagccttttgatggcaagatcaccaatccagatggtattgctccctcaggatggctctgggcctgcccctaagggcctgtggcctatggaatatgtcctccaggctttgctcagctgagctcctcttctgtaaggaaacccagtcat

SEQ ID NO: 32 - protein, 830 aa, Homo sapiens [sequence omitted]

SEQ ID NO: 33 - DNA, 2592 bp, Homo sapiens
  CDS (46)..(2313)
cgcgctccatctggtatcttggcctcagctgtccttgaagtcaccatggcgtggtccccaccagccaccctctttctgttcctgctgctgctaggccagccccctcccagcaggccacagtcactgggcaccactaagctccggctggtgggcccagagagcaagccagaggagggccgcctggaggtgctgcaccagggccagtggggcaccgtgtgtgatgacaactttgctatccaggaggccacagtggcttgccgccagctgggcttcgaagctgccttgacctgggcccacagtgccaagtacggccaaggggagggacccatctggctggacaatgtgcgctgtgtgggcacagagagctccttggaccagtgcgggtctaatggctggggagtcagtgactgcagtcactcagaagacgtaggggtgatatgccacccccggcgccatcgtggctacctttctgaaactgtctccaatgcccttgggccccagggccagcggctggaggaggtgcggctcaagcccatccttgccagtgccaagcagcatagcccagtgaccgagggagccgtggaggtgaagtatgagggccactggcggcaggtgtgtgaccagggctggaccatgaacaacagcagggtggtgtgcgggatgctgggcttccccagcgaggtgcctgccgacagccactactacaggaaagtctgggatctgaagatgagggaccctaagtctaggctgaagagcctgacgaataagaactccttctggatccaccaggtcacctgcctggggacagagccccacatggccaactgccaggtgcaggtggctccagcccggggcaagctgcggccagcctgcccaggtggcatgcacgctgtggtcagctgtgtggcagggcctcacttccgcccaccgaagacaaagccacaacgcaaagggtcctgggcagaggagccgagggtgcgcctgcgctccggggcccaggtgggcgagggccgggtggaagtgctcatgaaccgccagtggggcacggtctgtgaccacaggtggaacctcatctctgccagtgtcgtgtgtcgtcagctgggctttggctctgctcgggaggccctctttggggcccggctgggccaagggctagggcccatccacctgagtgaggtgcgctgcaggggatatgagcggaccctcagcgactgccctgccctggaagggtcccagaatggttgccaacatgagaatgatgctgctgtcaggtgcaatgtccctaacatgggctttcagaatcaggtgcgcttggctggtgggcgtatccctgaggaggggctattggaggtgcaggtggaggtgaacggggtcccacgctgggggagcgtgtgcagtgaaaactgggggctcaccgaagccatggtggcctgccgacagctcggcctgggttttgccatccatgcctacaaggaaacctggttctggtcggggacgccaagggcccaggaggtggtgatgagtggggtgcgctgctcaggcacagagctggccctgcagcagtgccagaggcacgggccggtgcactgctcccacggtggcgggcgcttcctggctggagtctcctgcatggacagtgcaccagacctggtgatgaacgcccagctagtgcaggagacggcctacttggaggaccgcccgctcagccagctgtattgtgcccacgaggagaactgcctctccaagtctgcggatcacatggactggccctacggataccgccgcctattgcgcttctccacacagatctacaatctgggccggactgactttcgtccaaagactggacgcgatagctgggtttggcaccagtgtcacaggcattaccacagcattgaggtcttcacccactacgacctcctcactctcaatggctccaaggtggctgaggggcacaaggccagcttctgtctggaggacacaaactgccccacaggactgcagcggcgctacgcatgtgccaactttggagaacagggagtgactgtaggctgctgggacacctaccggcatgacattgattgccagtgggtggatatcacagatgtgggccccgggaattatatcttccaggtgattgtgaatccccactatgaagtggcagagtcagatttctccaacaatatgctgcagtgccgctgcaagtatgatgggcaccgggtctggctgcacaactgccacacagggaattcatacccagccaatgcagaactctccctggagcaggaacagcgtctcaggaacaacctcatctgaagctgtcactgcacactcctagctgctgccgatacaccagatacctcagcttattggagccatgcccttcacagagtcccaactcagaggaaaagggccagtgccaaggggcaccaagaacctgctcaggaagccttttgatggcaagatcaccaatccagatggtattgctccctcaggatggctctgggcctgcccctaagggcctgtggcctatggaatatgtcctccaggctttgcttagctgagctccccttctgtaaggaaacccagtca

SEQ ID NO: 34 - protein, 756 aa, Homo sapiens
MAWSPPATLFLFLLLLGQPPPSRPQSLGTTKLRLVGPESKPEEGRLEVLHQGQWGTVCDDNFAIQEATVACRQLGFEAALTWAHSAKYGQGEGPIWLDNVRCVGTESSLDQCGSNGWGVSDCSHSEDVGVICHPRRHRGYLSETVSNALGPQGQRLEEVRLKPILASAKQHSPVTEGAVEVKYEGHWRQVCDQGWTMNNSRVVCGMLGFPSEVPADSHYYRKVWDLKMRDPKSRLKSLTNKNSFWIHQVTCLGTEPHMANCQVQVAPARGKLRPACPGGMHAVVSCVAGPHFRPPKTKPQRKGSWAEEPRVRLRSGAQVGEGRVEVLMNRQWGTVCDHRWNLISASVVCRQLGFGSAREALFGARLGQGLGPIHLSEVRCRGYERTLSDCPALEGSQNGCQHENDAAVRCNVPNMGFQNQVRLAGGRIPEEGLLEVQVEVNGVPRWGSVCSENWGLTEAMVACRQLGLGFAIHAYKETWFWSGTPRAQEVVMSGVRCSGTELALQQCQRHGPVHCSHGGGRFLAGVSCMDSAPDLVMNAQLVQETAYLEDRPLSQLYCAHEENCLSKSADHMDWPYGYRRLLRFSTQIYNLGRTDFRPKTGRDSWVWHQCHRHYHSIEVFTHYDLLTLNGSKVAEGHKASFCLEDTNCPTGLQRRYACANFGEQGVTVGCWDTYRHDIDCQWVDITDVGPGNYIFQVIVNPHYEVAESDFSNNMLQCRCKYDGHRVWLHNCHTGNSYPANAELSLEQEQRLRNNLI

SEQ ID NO: 35 - DNA, 1002 bp, Homo sapiens
  CDS (101)..(901)
gccgggacagacctctgctgccgccgcccccacgaacgtgtgacgacggctggaggccaacagagtccctacaggtggtgctcacggtaatgcaccgacaatgagtggctgttttccagtttctggcctccgctgcctatctagggacggcaggatggccgcgcagggcgcgccgcgcttcctcctgaccttcgacttcgacgagactatcgtggacgaaaacagcgacgattcgatcgtgcgcgccgcgccgggccagcggctcccggagagcctgcgagccacctaccgcgagggcttctacaacgagtacatgcagcgcgtcttcaagtacctgggcgagcagggcgtgcggccgcgggacctgagcgccatctacgaagccatccctttgtcgccaggcatgagcgacctgctgcagtttgtggcaaaacagggcgcctgcttcgaggtgattctcatctccgatgccaacacctttggcgtggagagctcgctgcgcgccgccggccaccacagcctgttccgccgcatcctcagcaacccgtcggggccggatgcgcggggactgctggctctgcggccgttccacacacacagctgcgcgcgctgccccgccaacatgtgcaagcacaaggtgctcagcgactacctgcgcgagcgggcccacgacggcgtgcacttcgagcgcctcttctacgtgggcgacggcgccaacgacttctgccccatggggctgctggcgggcggcgacgtggccttcccgcgccgcggctaccccatgcaccgcctcattcaggaggcccagaaggccgagcccagctcgttccgcgccagcgtggtgccctgggaaacggctgcagatgtgcgcctccacctgcaacaggtgctgaagtcgtgctgagtctggccgcctgcaggggggtacccgggccaacggcggagggggcggggaagggagattcggcaaagacagctttactactcccttttccctttggc

SEQ ID NO: 36 - protein, 267 aa, Homo sapiens
MSGCFPVSGLRCLSRDGRMAAQGAPRFLLTFDFDETIVDENSDDSIVRAAPGQRLPESLRATYREGFYNEYMQRVFKYLGEQGVRPRDLSAIYEAIPLSPGMSDLLQFVAKQGACFEVILISDANTFGVESSLRAAGHHSLFRRILSNPSGPDARGLLALRPFHTHSCARCPANMCKHKVLSDYLRERAHDGVHFERLFYVGDGANDFCPMGLLAGGDVAFPRRGYPMHRLIQEAQKAEPSSFRASVVPWETAADVRLHLQQVLKSC

SEQ ID NO: 37 - DNA, 903 bp, Homo sapiens
  CDS (4)..(804)
acaatgagtggctgttttccagtttctggcctccgctgcctatctagggacggcaggatggccgcgcagggcgcgccgcgcttcctcctgaccttcgacttcgacgagactatcgtggacgaaaacagcgacgattcgatcgtgcgcgccgcgccgggccagcggctcccggagagcctgcgagccacctaccgcgagggcttctacaacgagtacatgcagcgcgtcttcaagtacctgggcgagcagggcgtgcggccgcgggacctgagcgccatctacgaagccatccctttgtcgccaggcatgagcgacctgctgcagtttgtggcaaaacagggcgcctgcttcgaggtgattctcatctccgatgccaacacctttggcgtggagagctcgctgcgcgccgccggccaccacagcctgttccgccgcatcctcagcaacccgtcggggccggatgcgcggggactgctggctctgcggccgttccacacacacagctgcgcgcgctgccccgccaacatgtgcaagcacaaggtgctcagcgactacctgcgcgagcgggcccacgacggcgtgcacttcgagcgcctcttctacgtgggcgacggcgccaacgacttctgccccatggggctgctggcgggcggcgacgtggccttcccgcgccgcggctaccccatgcaccgcctcattcaggaggcccagaaggccgagcccagctcgttccgcgccagcgtggtgccctgggaaacggctgcagatgtgcgcctccacctgcaacaggtgctgaagtcgtgctgagtctggccgcctgcaggggggtacccgggccaacggcggagggggcggggaagggagattcggcaaagacagctttactactcccttttccctttg

SEQ ID NO: 38 - protein, 267 aa, Homo sapiens; identical to SEQ ID NO: 36

SEQ ID NO: 39 - DNA, 1991 bp, Homo sapiens
  CDS (8)..(1972)
gggcctgatggaggagtttgtggggctgcgtgagggcttctcaggggaccctgtgactctgcaggagctgtggggcccctgtccccacatccgccgagccatccaaggtggcctggagtggctaaagcagaaggtgttccgcctgggagaagactggtacttcctgatgaccctcggggtgctcatggccctggtcagctatgccatgaactttgccatcgggtgtgtggtccgaggcttctcccagagcatcacgccctcctctggaggttctggaatcccggagctgaagaccatgttggcgggtgtgatcttggaggactacctggatatcaagaactttggggccaaggtggtgggcctctcctgcaccctggccaccggcagcaccctgttcctgggcaaagtgggccctttcgtgcacttgtctgtaatgatcgctgcctacctgggccgtgtgcgcaccacgaccatcggggagcctgagaacaagagcaagcaaaacgaaatgctggtggcagcggcggcagtgggcgtggccacagtctttgcagctcccttcagcggcgtcctgttcagcatcgaggtcatgtcttcccacttctctgtccgggattactggaggggcttctttgcggccacctgcggggccttcatattccggctcctggcagtcttcaacagcgagcaggagaccatcacctccctctacaagaccagtttccgggtggacgttcccttcgacctgcctgagatcttcttttttgtggcgctgggtggcatctgcggcgtcctgagctgtgcttacctcttctgtcagcgaaccttcctcagcttcatcaagaccaatcggtacagctccaaactgctggctactagcaagcctgtgtactccgctctggccaccttgcttctcgcctccatcacctacccgcctggtgtgggccacttcctagcttctcggctgtccatgaagcagcatctggactcgctgttcgacaaccactcctgggcgctgatgacccagaactccagcccaccctggcccgaggagctcgacccccagcacctttggtgggaatggtaccacccgcggttcaccatctttgggacccttgccttcttcctggttatgaagttctggatgctgattctggccaccaccatccccatgcctgccgggtacttcatgcccatctttatccttggagctgccatcgggcgcctcttgggagaggctcttgccgtcgccttccctgagggcattgtgactggaggggttaccaatcccatcatgcccggggggtatgctctggcaggggctgcagccttctcaggggctgtgacccacaccatctccacggcgctgctggcctttgagctgaccggccagatagtgcatgcactgcccgtgctgatggcggtgctggcagccaacgccattgcacagagctgccagccctccttctatgatggcaccatcattgtcaagaagctgccatacctgccacggattctgggccgcaacatcggctcccaccatgtgagggtggagcacttcatgaaccacagcatcaccacactggccaaggacacgccgctggaggaggtggtcaaggttgtgacctccacagacgtgaccgagtatcccctggtggagagcacagagtcccagatcctggtaggcatcgtgcagagggcccagctggtgcaggccctccaggctgagcctccttccagggctccaggacaccagcagcgtctccaggacatcttggccaggggctgccccacggaaccagtgaccctgacgctattctcagagaccaccttgcaccaggcacaaaacctctttaagctgttgaaccttcagtccctcttcgtgacatcgcggggcagagctgtgggctgcgtgtcctgggtggagatgaagaaagcaatttccaacctgacaaatccgccagctccaaagtgagccggcccagcaagat

SEQ ID NO: 40 - protein, 655 aa, Homo sapiens
MEEFVGLREGFSGDPVTLQELWGPCPHIRRAIQGGLEWLKQKVFRLGEDWYFLMTLGVLMALVSYAMNFAIGCVVRGFSQSITPSSGGSGIPELKTMLAGVILEDYLDIKNFGAKVVGLSCTLATGSTLFLGKVGPFVHLSVMIAAYLGRVRTTTIGEPENKSKQNEMLVAAAAVGVATVFAAPFSGVLFSIEVMSSHFSVRDYWRGFFAATCGAFIFRLLAVFNSEQETITSLYKTSFRVDVPFDLPEIFFFVALGGICGVLSCAYLFCQRTFLSFIKTNRYSSKLLATSKPVYSALATLLLASITYPPGVGHFLASRLSMKQHLDSLFDNHSWALMTQNSSPPWPEELDPQHLWWEWYHPRFTIFGTLAFFLVMKFWMLILATTIPMPAGYFMPIFILGAAIGRLLGEALAVAFPEGIVTGGVTNPIMPGGYALAGAAAFSGAVTHTISTALLAFELTGQIVHALPVLMAVLAANAIAQSCQPSFYDGTIIVKKLPYLPRILGRNIGSHHVRVEHFMNHSITTLAKDTPLEEVVKVVTSTDVTEYPLVESTESQILVGIVQRAQLVQALQAEPPSRAPGHQQRLQDILARGCPTEPVTLTLFSETTLHQAQNLFKLLNLQSLFVTSRGRAVGCVSWVEMKKAISNLTNPPAPK

SEQ ID NO: 41 - DNA, 645 bp, Homo sapiens
  CDS (31)..(603)
actggagtgttgctacaaagataccccaaaatgtggaagcaactgtggaactgggtaacaggccttccagaaagcccccaatttgagtcccatcaaaggttagttcttctgcctattcttgaaattcatgtaaactcaaaatcttacagaatgtattcattctgtttgggtttcttaactcttgtgagacagagtcttgctctgtcacccaggctggaatgcagtggcgccatctcggctcactgcaagatctgtgagccgtgccctacgtcgtggctgcccttcgggggctcctgctactatttctctgtgccgaagaccacgtgggcagaggcgcagggccactgcgccgatgccagcgcacatctggctgccttcccagaagataggaaagtcgccttttattctgtacttttgggtaggtgcctcttcggaataggcctggccagagtgggtgggtggaggtggcaggtggcaccggggacccagatagatgcacccgcagtaggacaaggggcctgcttctgtcaggaaagcatttctggtcttcctgcctcggaactcaggctggaaaagtggtggcactgctcaaaaacactgcaataacaaaccacagatgtctgttccaaagattacaatcaaaac

SEQ ID NO: 42 - protein, 191 aa, Homo sapiens [sequence omitted]

SEQ ID NO: 43 - DNA, 7337 bp, Homo sapiens
  CDS (1)..(4212)
  misc_feature (6034): Wherein "n" is A, or T, or C, or G.
  misc_feature (7262): Wherein "n" is A, or T, or C, or G.
atgcccatgggacattctgacaggtggtcttggcgtctcctgaggctggcactgccactcccagtctggttgccggctgggggtggccgaggcgctgactctccatgtctctgttccaggccccacgtgtgtgctgagcaggagctgaccctggtgggccgccgccagccgtgcgtgcaggccttaagccacacggtgccggtgtggaaggccggctgtgggtggcaggcgtggtgcgtgggtcatgagcggaggaccgtctactacatgggctacaggcaggtgtataccacggaggcccggaccgtgctcaggtgctgccgagggtggatgcagcagcccgacgaggagggctgcctctcggatgtgggtgagtgtgccaacgccaacgggggctgtgcgggtcggtgccgggacaccgtggggggcttctactgccgctggcccccccccagccaccagctgcagggtgatggcgagacttgccaagatgtggacgaatgccgaacccacaacggtggctgccagcaccggtgcgtgaacaccccaggctcctacctctgtgagtgcaagcccggcttccggctccacactgacagcaggacctgcgccattaactcctgcgccctgggcaatggcggctgccagcaccactgtgtccagctcacaatcactcggcatcgctgccagtgccggcccgggttccagctccaggaggacggcaggcattgtgtccgtagaagcccgtgtgccaacaggaacggcagctgcatgcacaggtgccaggtggtccggggcctcgcccgctgtgagtgccacgtgggctatcagctagcagcggacggcaaggcctgtgaagatgtggacgaatgtgccgcagggctggcccagtgtgcccatggctgcctcaacacccaggggtccttcaagtgcgtgtgtcacgcgggctatgagctgggcgccgatggccggcagtgctaccgtattgagatggaaatcgtgaacagctgtgaggccaacaacggcggctgctcccatggctgcagccacaccagtgctgggcccctgtgcacctgtccccgcggctacgagctggacacagatcagaggacctgcatcagatgtcgacgactgtgcagacagcccgtgctgcagcaggtgtgcaccaacaaccctggcgggtacgagtgcggctgctacgccggctaccggctcagtgccgatggctgcggctgcgaggatgtggatgagtgcgcctccagccgtggcggctgcgagcaccactgcaccaacctggccggctccttccagtgctcctgcgaggccggctaccggctgcacgaggaccgtaggggctgcagcgccctggaggagccgatggtggacctggacggcgagctgcctttcgtgcggcccctgccccacattgccgtgctccaggacgagctgccgcaactcttccaggatgacgacgtcggggccgatgaggaagaggcagagttgcggggcgaacacacgctcacagagaagtttgtctgcctggatgactcctttggccatgactgcagcttgacctgtgatgactgcaggaacggagggacctgcctcctgggcctggatggctgtgattgccccgagggctggactgggctcatctgcaatgagagttgtcctccggacacctttgggaagaactgcagcttctcctgcagctgtcagaatggtgggacctgcgactctgtcacgggggcctgccgctgccccccgggtgtcagtggaactaactgtgaggatggctgccccaagggctactatggcaagcactgtcgcaagaaatgcaactgtgccaaccggggccggtgccaccgcctctacggggcctgcctctgcgacccagggctctacggccgcttctgccacctcgcctgcccgccgtgggcctttgggccgggctgctcggaggagtgccagtgtgtgcagccccacacgcagtcctgtgacaagagggatggcagctgctcctgcaaggctggcttccggggcgagcgctgtcaggcagagtgtgagccgggctactttgggccggggtgctggcaggcatgcacctgcccagtgggcgtggcctgtgactccgtgagcggcgagtgtgggaagcggtgtcctgctggcttccagggagaggactgtggccaagagtgcccggtggggacctttggcgtgaactgctcgagctcctgctcctgtgggggggccccctgccacggggtcacggggcagtgccggtgtccgccggggaggactggggaagactgtgaggcaggtgagtgtgagggcctctgggggctgggctgccaggagatctgcccagcatgccataacgctgctcgctgcgaccctgagaccggagcctgcctgtgcctccctggctttgtcggcagccgctgccaggactgtgaggcaggctggtatggtcccagctgccagacaatgtgctcttgtgccaatgatgggcactgccaccaagacacgggacactgcagctgtgcccccgggtggaccggctttagctgccagagagcctgtgatactgggcactggggacctgactgcagccacccctgcaactgcagcgctggccacgggagctgtgatgccatcagcggcctgtgtctgtgtgaggctggctacgtgggcccgcggtgcgagcagtcagagtgtccccagggccactttgggcccggctgtgagcagcggtgccagtgtcagcatggagcagcctgtgaccacgtcagcggggcctgcacctgcccggccggctggaggggcaccttctgcgagcatgcctgcccggccggcttctttggattggactgtcgcagtgcctgcaactgcaccgccggagctgcctgtgatgccgtgaatggctcctgcctctgccccgctggccgccggggcccccgctgtgccgagagtgcctgcccagcccacacctacgggcacaattgcagccaggcctgtgcctgctttaacggggcctcctgtgaccctgtccacgggcagtgccactgtgcccctggctggatggggccctcctgcctgcaggcctgccctgccggcctgtacggcgacaactgtcggcattcctgcctctgccagaacggagggacctgtgaccctgtctcaggccactgtgcgtgcccagagggctgggccggcctggcctgtgaggtagagtgcctcccccgggacgtcagagctggctgccggcacagcggcggttgcctcaacgggggcctgtgtgacccgcacacgggccgctgcctctgcccagccggctggactggggacaagtgtcagagccctgcagcctgtgccaagggcacattcgggcctcactgtgaggggcgctgtgcctgccggtggggaggcccctgccaccttgccaccggggcctgcctctgccctccggggtggcgggggcctcatctttctgcagcctgcctgcggggctggtttggagaggcctgtgcccagcgctgcagctgcccgcctggcgctgcctgccaccacgtcactggggcctgccgctgtccccctggcttcactggctccggctgcgagcaggcctgcccacccggcagctttggggaggactgtgcgcagatgtgccagtgtcccggtgagaacccggcctgccaccctgccaccgggacctgctcatgtgctgctggctaccacggccccagctgccagcaacgatgtccgcccgggcggtatgggccaggctgtgaacagctgtgtgggtgtctcaacgggggctcctgtgatgcggccacgggggcctgccgctgccccactgggttcctcgggacggactgcaacctcacctgtccgcagggccgcttcggccccaactgcacccacgtgtgtgggtgtgggcagggggcggcctgcgaccctgtgaccggcacctgcctctgccccccggggagagccggcgtccgctgtgagcgaggctgcccccagaaccggtttggcgtgggctgcgagcacacctgctcctgcagaaatgggggcctgtgccacgccagcaagcggcagctgctcctgtggcctgggctggacggggcggcactgcgagctggcctgtccccctgggcgctacggagccgcctgccatctggagtgctcctgccacaacaacagcacgtgtgagcctgccacgggcacctgccgctgcggccccggcttctatggccaggcctgcgagcacccctgtccccctggcttccacggggctggctgccaggggttgtgctggtgtcaacatggagccccctgcgaccccatcagtggccgatgcctctgccctgccggcttccacggccacttctgtgagagggggtgtgagccaggttcatttggagagggctgccaccagcgctgtgactgtgacgggggggcaccctgtgaccctgtcaccggtctctgcctttgcccaccagggcgctcaggagccacctgtaacctggattgcagaaggggccagtttgggcccagctgcaccctgcactgtgactgcgggggtggggctgactgcgaccctgtcagtgggcagtgtcactgtgtggatggctacatggggcccacgtgccgggaaggtgggcccctccggctccccgagaacccgtccttagcccagggctcagcgggcacactgcccgcctccagcagacccacatcccggagcggtggaccagcgaggcactagtagaggcagtcccgtggagcccgcctctccagtcccagccagaggggaccctggcctttggtgaccactgagaaggacacttcacgggcccagagctcctggtactgcccttcctttgagggccgtggagggctgtggacagcccagcaacctgtcgctcttggaggctggtgtggccttgaggagggaagcctcgcatggccgctggaagagaggcgcctcctggcctggctctgcagaacccaggggcacgctctgggcctgggctgaggaagtcccgctctccccgcggctctgagttggactgaggacaggtgtgggcgccagtgtgggtgcaggcgcaggtgcaggcacagggccactgtcctccaggcaggctttttggtgctaggccctgggactggaagtcgcccagcccgtatttatgtaaaggtatttatgggccactgcacatgcccgctgcagccctgggatcagctggaagctgcctgtcatctcctgcccaatccccagaaaccctgattcaggtctgcaggctcctgcgggctcaccaggctgctggctccggtaccatgtaaacctaggaaggtaaaggagcaggcaacctcctcgtggcctgtgtgtttgctgtgttacgtggactctgtgtgggctcctccctggggcccggccagcataacggtgcacccagggacctcccagtgcacccggggccctttgcaggggtgggggtgccacacaagtgaagaagttgggactcatctcagttcccagtgctattgaggagaacgctggggctgcattcattaccgctgagacccagagactggctgttcccagagaatggcccagggggaggagggctggtgtggaggggcaacctggactgaggccgaactcccttgggctcaccccacccacccctacctgagcatcagcagtggggggagggcagcatcgcaggggcagggactccctgggtgaggacagaccagccctcccgagcacctggcactcatgggctgaggctgacttctcctggaagaagggcccagagtggaaggaagaggcagagggtagaggtggtggctgggggctcctctgcagagtggggtggccaatggagagggctgcactcacaccgcaacataggactctctctcccttaagaaggcccccttagggtctgggctgccgcccccatcaccctaaaaccagccaaggtagctgaggccccagggcagacaatttcaccagcaggangaggaggagtccagtgagcttggttgctcacagacagcaagggagctgtcacagaggaagctgatgaatggaccgctgtggggagactttaaagtagaacagtgataagggagggcaggatggtggggatgcagaagcagcagccagagagagacggactggggtgcagacggagtgtggaaaacgcataccttgaaatgaagcatccagcagatggggtgagtggatacagctcaggagattctcccaggaatagcagggaggcgtaaagagagacaacgtacagagatagatgaatggaaatgggtaagggaggtgttcattcacatccatctaactgcaaaatacaaaagtaagaagtcattgacatgaagcaacgacgaccaagacgttctcagatctaaaggtgaatgatctcagtcagcctggaaatgcacaaggtggaaaaataacataaaaaagccataagaccttgaagaacatcaatgtcaaagataaattctaaagtcccagagaaaaaagaatgggaatcaaattgacctcagactatacgtgagaaacacggagagccagaaaactgtgatgttccatcctcagagtttgaaggaaatatttgaaggctgaattttacatccagctaaactatcaaaggcatgcaaagtccatgttattcttaggccttcaaggcctcggccatttttctacagaaaagcctgattttaaaatgctcttagagacgttctccagccagaagagaaagaagccaggagggtgctctgagatattcagtcaccacagttcccaaatggcctaggaattcagagagtcagaatatcaccattactccccaatgggaacccccgacagtctcagcatggtgtgagggtgtggacggggggcctggcaggtaccaatcactcatcccgctcagtgaagacacagtgttcagctacggaagccataaggcaggccgagcttctgcccatccggaggaaatctcagctatccaacggcggtcaggagcagaggaaaataaagcagaataactagaaaacacgctcacagatcctaatgttaacggttacaaatgacgacggaaaaacaaactcctgaccatatattatatagtttcaagcagcaagaaggaggatattgaacattctcaacacacataataaacgcttgagatgatgatatgctcattaccctgatttgatcactagacatnccatgtatcaaaacatcactgtgtatccgatgaatatctacaattattgtcaattaaaaacatcattaaaaacaa

SEQ ID NO: 44 - protein, 1404 aa, Homo sapiens
MPMGHSDRWSWRLLRLALPLPVWLPAGGGRGADSPCLCSRPHVCAEQELTLVGRRQPCVQALSHTVPVWKAGCGWQAWCVGHERRTVYYMGYRQVYTTEARTVLRCCRGWMQQPDEEGCLSDVGECANANGGCAGRCRDTVGGFYCRWPPPSHQLQGDGETCQDVDECRTHNGGCQHRCVNTPGSYLCECKPGFRLHTDSRTCAINSCALGNGGCQHHCVQLTITRHRCQCRPGFQLQEDGRHCVRRSPCANRNGSCMHRCQVVRGLARCECHVGYQLAADGKACEDVDECAAGLAQCAHGCLNTQGSFKCVCHAGYELGADGRQCYRIEMEIVNSCEANNGGCSHGCSHTSAGPLCTCPRGYELDTDQRTCIRCRRLCRQPVLQQVCTNNPGGYECGCYAGYRLSADGCGCEDVDECASSRGGCEHHCTNLAGSFQCSCEAGYRLHEDRRGCSALEEPMVDLDGELPFVRPLPHIAVLQDELPQLFQDDDVGADEEEAELRGEHTLTEKFVCLDDSFGHDCSLTCDDCRNGGTCLLGLDGCDCPEGWTGLICNESCPPDTFGKNCSFSCSCQNGGTCDSVTGACRCPPGVSGTNCEDGCPKGYYGKHCRKKCNCANRGRCHRLYGACLCDPGLYGRFCHLACPPWAFGPGCSEECQCVQPHTQSCDKRDGSCSCKAGFRGERCQAECEPGYFGPGCWQACTCPVGVACDSVSGECGKRCPAGFQGEDCGQECPVGTFGVNCSSSCSCGGAPCHGVTGQCRCPPGRTGEDCEAGECEGLWGLGCQEICPACHNAARCDPETGACLCLPGFVGSRCQDCEAGWYGPSCQTMCSCANDGHCHQDTGHCSCAPGWTGFSCQRACDTGHWGPDCSHPCNCSAGHGSCDAISGLCLCEAGYVGPRCEQSECPQGHFGPGCEQRCQCQHGAACDHVSGACTCPAGWRGTFCEHACPAGFFGLDCRSACNCTAGAACDAVNGSCLCPAGRRGPRCAESACPAHTYGHNCSQACACFNGASCDPVHGQCHCAPGWMGPSCLQACPAGLYGDNCRHSCLCQNGGTCDPVSGHCACPEGWAGLACEVECLPRDVRAGCRHSGGCLNGGLCDPHTGRCLCPAGWTGDKCQSPAACAKGTFGPHCEGRCACRWGGPCHLATGACLCPPGWRGPHLSAACLRGWFGEACAQRCSCPPGAACHHVTGACRCPPGFTGSGCEQACPPGSFGEDCAQMCQCPGENPACHPATGTCSCAAGYHGPSCQQRCPPGRYGPGCEQLCGCLNGGSCDAATGACRCPTGFLGTDCNLTCPQGRFGPNCTHVCGCGQGAACDPVTGTCLCPPGRAGVRCERGCPQNRFGVGCEHTCSCRNGGLCHASKRQLLLWPGLDGAALRAGLSPWALRSRLPSGVLLPQQQHV

SEQ ID NO: 45 - DNA, 7319 bp, Homo sapiens
  CDS (1)..(4194)
  misc_feature (6016): Wherein "n" is A, or T, or C, or G.
  misc_feature (7244): Wherein "n" is A, or T, or C, or G.
atgcccatgggacattctgacaggtggtcttggcgtctcctgaggctggcactgccactcccagtctggttgccggctgggggtggccgaggcgctgactctccatgtctctgttccaggccccacgtgtgtgctgagcaggagctgaccctggtgggccgccgccagccgtgcgtgcaggccttaagccacacggtgccggtgtggaaggccggctgtgggtggcaggcgtggtgcgtgggtcatgagcggagaaccgtctactacatgggctacaggcaggtgtataccacggaggcccggaccgtgctcaggtgctgccgagggtggacgcagcagcccgacgaggagggctgcctctcggctgaatgcagcgccagcctctgttttcacggtggccgttgtgtgccaggctcagcccagccgtgtcactgtccccccggcttccagggaccccgctgtcagtatgatgtggacgaatgccgaacccacaacggtggctgccagcaccggtgcgtgaacaccccaggctcctacctctgtgagtgcaagcccggcttccggctccacactgacagcaggacctgcctggccattaactcctgcgccctgggcaatggcggctgccagcaccactgtgtccagctcacaatcactcggcatcgctgccagtgccggcccgggttccagctccaggaggacggcaggcattgtgtccgtagaagcccgtgtgccaacaggaacggcagctgcatgcacaggtgccaggtggtccggggcctcgcccgctgtgagtgccacgtgggctatcagctagcagcggacggcaaggcctgtgaagatgtggacgaatgtgccgcagggctggcccagtgtgcccatggctgcctcaacacccaggggtccttcaagtgcgtgtgtcacgcgggctatgagctgggcgccgatggccggcagtgctaccgtattgagatggaaatcgtgaacagctgtgaggccaacaacggcggctgctcccatggctgcagccacaccagtgctgggcccctgtgcacctgtccccgcggctacgagctggacacagatcagaggacctgcatcagatgtcgacgactgtgcagacagcccgtgctgcagcaggtgtgcaccaacaaccctggcgggtacgagtgcggctgctacgccggctaccggctcagtgccgatggctgcggctgcgaggatgtggatgagtgcgcctccagccgtggcggctgcgagcaccactgcaccaacctggccggctccttccagtgctcctgcgaggccggctaccggctgcacgaggaccgtaggggctgcagcgccctggaggagccgatggtggacctggacggcgagctgcctttcgtgcggcccctgccccacattgccgtgctccaggacgagctgccgcaactcttccaggatgacgacgtcggggccgatgaggaagaggcagagttgcggggcgaacacacgctcacagagaagtttgtctgcctggatgactcctttggccatgactgcagcttgacctgtgatgactgcaggaacggagggacctgcctcctgggcctggatggctgtgattgccccgagggctggactgggctcatctgcaatgagagttgtcctccggacacctttgggaagaactgcagcttctcctgcagctgtcagaatggtgggacctgcgactctgtcacgggggcctgccgctgccccccgggtgtcagtggaactaactgtgaggatggctgccccaagggctactatggcaagcactgtcgcaagaaatgcaactgtgccaaccggggccggtgccaccgcctctacggggcctgcctctgcgacccagggctctacggccgcttctgccacctcgcctgcccgccgtgggcctttgggccgggctgctcggaggagtgccagtgtgtgcagccccacacgcagtcctgtgacaagagggatggcagctgctcctgcaaggctggcttccggggcgagcgctgtcaggcagagtgtgagccgggctactttgggccggggtgctggcaggcatgcacctgcccagtgggcgtggcctgtgactccgtgagcggcgagtgtgggaagcggtgtcctgctggcttccagggagaggactgtggccaagagtgcccggtggggacctttggcgtgaactgctcgagctcctgctcctgtgggggggccccctgccacggggtcacggggcagtgccggtgtccgccggggaggactggggaagactgtgaggcaggtgagtgtgagggcctctgggggctgggctgccaggagatctgcccagcatgccataacgctgctcgctgcgaccctgagaccggagcctgcctgtgcctccctggctttgtcggcagccgctgccaggactgtgaggcaggctggtatggtcccagctgccagacaatgtgctcttgtgccaatgatgggcactgccaccaagacacgggacactgcagctgtgcccccgggtggaccggctttagctgccagagagcctgtgatactgggcactggggacctgactgcagccacccctgcaactgcagcgctggccacgggagctgtgatgccatcagcggcctgtgtctgtgtgaggctggctacgtgggcccgcggtgcgagcagtcagagtgtccccagggccactttgggcccggctgtgagcagcggtgccagtgtcagcatggagcagcctgtgaccacgtcagcggggcctgcacctgcccggccggctggaggggcaccttctgcgagcatgcctgcccggccggcttctttggattggactgtcgcagtgcctgcaactgcaccgccggagctgcctgtgatgccgtgaatggctcctgcctctgccccgctggccgccggggcccccgctgtgccgagagtgcctgcccagcccacacctacgggcacaattgcagccaggcctgtgcctgctttaacggggcctcctgtgaccctgtccacgggcagtgccactgtgcccctggctggatggggccctcctgcctgcaggcctgccctgccggcctgtacggcgacaactgtcggcattcctgcctctgccagaacggagggacctgtgaccctgtctcaggccactgtgcgtgcccagagggctgggccggcctggcctgtgaggtagagtgcctcccccgggacgtcagagctggctgccggcacagcggcggttgcctcaacgggggcctgtgtgacccgcacacgggccgctgcctctgcccagccggctggactggggacaagtgtcagagccctgcagcctgtgccaagggcacattcgggcctcactgtgaggggcgctgtgcctgccggtggggaggcccctgccaccttgccaccggggcctgcctctgccctccggggtggcgggggcctcatctttctgcagcctgcctgcggggctggtttggagaggcctgtgcccagcgctgcagctgcccgcctggcgctgcctgccaccacgtcactggggcctgccgctgtccccctggcttcactggctccggctgcgagcaggcctgcccacccggcagctttggggaggactgtgcgcagatgtgccagtgtcccggtgagaacccggcctgccaccctgccaccgggacctgctcatgtgctgctggctaccacggccccagctgccagcaacgatgtccgcccgggcggtatgggccaggctgtgaacagctgtgtgggtgtctcaacgggggctcctgtgatgcggccacgggggcctgccgctgccccactgggttcctcgggacggactgcaacctcacctgtccgcagggccgcttcggccccaactgcacccacgtgtgtgggtgtgggcagggggcggcctgcgaccctgtgaccggcacctgcctctgccccccggggagagccggcgtccgctgtgagcgaggctgcccccagaaccggtttggcgtgggctgcgagcacacctgctcctgcagaaatgggggcctgtgccacgccagcaagcggcagctgctcctgtggcctgggctggacggggcggcactgcgagctggcctgtccccctgggcgctacggagccgcctgccatctggagtgctcctgccacaacaacagcacgtgtgagcctgccacgggcacctgccgctgcggccccggcttctatggccaggcctgcgagcacccctgtccccctggcttccacggggctggctgccaggggttgtgctggtgtcaacatggagccccctgcgaccccatcagtggccgatgcctctgccctgccggcttccacggccacttctgtgagagggggtgtgagccaggttcatttggagagggctgccaccagcgctgtgactgtgacgggggggcaccctgtgaccctgtcaccggtctctgcctttgcccaccagggcgctcaggagccacctgtaacctggattgcagaaggggccagtttgggcccagctgcaccctgcactgtgactgcgggggtggggctgactgcgaccctgtcagtgggcagtgtcactgtgtggatggctacatggggcccacgtgccgggaaggtgggcccctccggctccccgagaacccgtccttagcccagggctcagcgggcacactgcccgcctccagcagacccacatcccggagcggtggaccagcgaggcactagtagaggcagtcccgtggagcccgcctctccagtcccagccagaggggaccctggcctttggtgaccactgagaaggacacttcacgggcccagagctcctggtactgcccttcctttgagggccgtggagggctgtggacagcccagcaacctgtcgctcttggaggctggtgtggccttgaggagggaagcctcgcatggccgctggaagagaggcgcctcctggcctggctctgcagaacccaggggcacgctctgggcctgggctgaggaagtcccgctctccccgcggctctgagttggactgaggacaggtgtgggcgccagtgtgggtgcaggcgcaggtgcaggcacagggccactgtcctccaggcaggctttttggtgctaggccctgggactggaagtcgcccagcccgtatttatgtaaaggtatttatgggccactgcacatgcccgctgcagccctgggatcagctggaagctgcctgtcatctcctgcccaatccccagaaaccctgattcaggtctgcaggctcctgcgggctcaccaggctgctggctccggtaccatgtaaacctaggaaggtaaaggagcaggcaacctcctcgtggcctgtgtgtttgctgtgttacgtggactctgtgtgggctcctccctggggcccggccagcataacggtgcacccagggacctcccagtgcacccggggccctttgcaggggtgggggtgccacacaagtgaagaagttgggactcatctcagttcccagtgctattgaggagaacgctggggctgcattcattaccgctgagacccagagactggctgttcccagagaatggcccagggggaggagggctggtgtggaggggcaacctggactgaggccgaactcccttgggctcaccccacccacccctacctgagcatcagcagtggggggagggcagcatcgcaggggcagggactccctgggtgaggacagaccagccctcccgagcacctggcactcatgggctgaggctgacttctcctggaagaagggcccagagtggaaggaagaggcagagggtagaggtggtggctgggggctcctctgcagagtggggtggccaatggagagggctgcactcacaccgcaacataggactctctctcccttaagaaggcccccttagggtctgggctgccgcccccatcaccctaaaaccagccaaggtagctgaggccccagggcagacaatttcaccagcaggangaggaggagtccagtgagcttggttgctcacagacagcaagggagctgtcacagaggaagctgatgaatggaccgctgtggggagactttaaagtagaacagtgataagggagggcaggatggtggggatgcagaagcagcagccagagagagacggactggggtgcagacggagtgtggaaaacgcataccttgaaatgaagcatccagcagatggggtgagtggatacagctcaggagattctcccaggaatagcagggaggcgtaaagagagacaacgtacagagatagatgaatggaaatgggtaagggaggtgttcattcacatccatctaactgcaaaatacaaaagtaagaagtcattgacatgaagcaacgacgaccaagacgttctcagatctaaaggtgaatgatctcagtcagcctggaaatgcacaaggtggaaaaataacataaaaaagccataagaccttgaagaacatcaatgtcaaagataaattctaaagtcccagagaaaaaagaatgggaatcaaattgacctcagactatacgtgagaaacacggagagccagaaaactgtgatgttccatcctcagagtttgaaggaaatatttgaaggctgaattttacatccagctaaactatcaaaggcatgcaaagtccatgttattcttaggccttcaaggcctcggccatttttctacagaaaagcctgattttaaaatgctcttagagacgttctccagccagaagagaaagaagccaggagggtgctctgagatattcagtcaccacagttcccaaatggcctaggaattcagagagtcagaatatcaccattactccccaatgggaacccccgacagtctcagcatggtgtgagggtgtggacggggggcctggcaggtaccaatcactcatcccgctcagtgaagacacagtgttcagctacggaagccataaggcaggccgagcttctgcccatccggaggaaatctcagctatccaacggcggtcaggagcagaggaaaataaagcagaataactagaaaacacgctcacagatcctaatgttaacggttacaaatgacgacggaaaaacaaactcctgaccatatattatatagtttcaagcagcaagaaggaggatattgaacattctcaacacacataataaacgcttgagatgatgatatgctcattaccctgatttgatcactagacatnccatgtatcaaaacatcactgtgtatccgatgaatatctacaattattgtcaattaaaaacatcattaaaaacaa

SEQ ID NO: 46 - protein, 1398 aa, Homo sapiens
MPMGHSDRWSWRLLRLALPLPVWLPAGGGRGADSPCLCSRPHVCAEQELTLVGRRQPCVQALSHTVPVWKAGCGWQAWCVGHERRTVYYMGYRQVYTTEARTVLRCCRGWTQQPDEEGCLSAECSASLCFHGGRCVPGSAQPCHCPPGFQGPRCQYDVDECRTHNGGCQHRCVNTPGSYLCECKPGFRLHTDSRTCLAINSCALGNGGCQHHCVQLTITRHRCQCRPGFQLQEDGRHCVRRSPCANRNGSCMHRCQVVRGLARCECHVGYQLAADGKACEDVDECAAGLAQCAHGCLNTQGSFKCVCHAGYELGADGRQCYRIEMEIVNSCEANNGGCSHGCSHTSAGPLCTCPRGYELDTDQRTCIRCRRLCRQPVLQQVCTNNPGGYECGCYAGYRLSADGCGCEDVDECASSRGGCEHHCTNLAGSFQCSCEAGYRLHEDRRGCSALEEPMVDLDGELPFVRPLPHIAVLQDELPQLFQDDDVGADEEEAELRGEHTLTEKFVCLDDSFGHDCSLTCDDCRNGGTCLLGLDGCDCPEGWTGLICNESCPPDTFGKNCSFSCSCQNGGTCDSVTGACRCPPGVSGTNCEDGCPKGYYGKHCRKKCNCANRGRCHRLYGACLCDPGLYGRFCHLACPPWAFGPGCSEECQCVQPHTQSCDKRDGSCSCKAGFRGERCQAECEPGYFGPGCWQACTCPVGVACDSVSGECGKRCPAGFQGEDCGQECPVGTFGVNCSSSCSCGGAPCHGVTGQCRCPPGRTGEDCEAGECEGLWGLGCQEICPACHNAARCDPETGACLCLPGFVGSRCQDCEAGWYGPSCQTMCSCANDGHCHQDTGHCSCAPGWTGFSCQRACDTGHWGPDCSHPCNCSAGHGSCDAISGLCLCEAGYVGPRCEQSECPQGHFGPGCEQRCQCQHGAACDHVSGACTCPAGWRGTFCEHACPAGFFGLDCRSACNCTAGAACDAVNGSCLCPAGRRGPRCAESACPAHTYGHNCSQACACFNGASCDPVHGQCHCAPGWMGPSCLQACPAGLYGDNCRHSCLCQNGGTCDPVSGHCACPEGWAGLACEVECLPRDVRAGCRHSGGCLNGGLCDPHTGRCLCPAGWTGDKCQSPAACAKGTFGPHCEGRCACRWGGPCHLATGACLCPPGWRGPHLSAACLRGWFGEACAQRCSCPPGAACHHVTGACRCPPGFTGSGCEQACPPGSFGEDCAQMCQCPGENPACHPATGTCSCAAGYHGPSCQQRCPPGRYGPGCEQLCGCLNGGSCDAATGACRCPTGFLGTDCNLTCPQGRFGPNCTHVCGCGQGAACDPVTGTCLCPPGRAGVRCERGCPQNRFGVGCEHTCSCRNGGLCHASKRQLLLWPGLDGAALRAGLSPWALRSRLPSGVLLPQQQHV

SEQ ID NO: 47 - DNA, 4733 bp, Homo sapiens
  CDS (1)..(4350)
atgcccatgggacattctgacaggtggtcttggcgtctcctgaggctggcactgccactcccagtctggttgccggctgggggtggccgaggcgctgactctccatgtctctgttccaggccccacgtgtgtgctgagcaggagctgaccctggtgggccgccgccagccgtgcgtgcaggccttaagccacacggtgccggtgtggaaggccggctgtgggtggcaggcgtggtgcgtgggtcatgagcggagaaccgtctactacatgggctacaggcaggtgtataccacggaggcccggaccgtgctcaggtgctgccgagggtggacgcagcagcccgacgaggagggctgcctctcggctgaatgcagcgccagcctctgttttcacggtggccgttgtgtgccaggctcagcccagccgtgtcactgtccccccggcttccagggaccccgctgtcagtatgatgtggacgaatgccgaacccacaacggtggctgccagcaccggtgcgtgaacaccccaggctcctacctctgtgagtgcaagcccggcttccggctccacactgacagcaggacctgcctggccattaactcctgcgccctgggcaatggcggctgccagcaccactgtgtccagctcacaatcactcggcatcgctgccagtgccggcccgggttccagctccaggaggacggcaggcattgtgtccgtagaagcccgtgtgccaacaggaacggcagctgcatgcacaggtgccaggtggtccggggcctcgcccgctgtgagtgccacgtgggctatcagctagcagcggacggcaaggcctgtgaagatgtggacgaatgtgccgcagggctggcccagtgtgcccatggctgcctcaacacccaggggtccttcaagtgcgtgtgtcacgcgggctatgagctgggcgccgatggccggcagtgctaccgtattgagatggaaatcgtgaacagctgtgaggccaacaacggcggctgctcccatggctgcagccacaccagtgctgggcccctgtgcacctgtccccgcggctacgagctggacacagatcagaggacctgcatcagatgtcgacgactgtgcagacagcccgtgctgcagcaggtgtgcaccaacaaccctggcgggtacgagtgcggctgctacgccggctaccggctcagtgccgatggctgcggctgcgaggatgtggatgagtgcgcctccagccgtggcggctgcgagcaccactgcaccaacctggccggctccttccagtgctcctgcgaggccggctaccggctgcacgaggaccgtaggggctgcagcgccctggaggagccgatggtggacctggacggcgagctgcctttcgtgcggcccctgccccacattgccgtgctccaggacgagctgccgcaactcttccaggatgacgacgtcggggccgatgaggaagaggcagagttgcggggcgaacacacgctcacagagaagtttgtctgcctggatgactcctttggccatgactgcagcttgacctgtgatgactgcaggaacggagggacctgcctcctgggcctggatggctgtgattgccccgagggctggactgggctcatctgcaatgagagttgtcctccggacacctttgggaagaactgcagcttctcctgcagctgtcagaatggtgggacctgcgactctgtcacgggggcctgccgctgccccccgggtgtcagtggaactaactgtgaggatggctgccccaagggctactatggcaagcactgtcgcaagaaatgcaactgtgccaaccggggccggtgccaccgcctctacggggcctgcctctgcgacccagggctctacggccgcttctgccacctcgcctgcccgccgtgggcctttgggccgggctgctcggaggagtgccagtgtgtgcagccccacacgcagtcctgtgacaagagggatggcagctgctcctgcaaggctggcttccggggcgagcgctgtcaggcagagtgtgagctgggctactttgggccggggtgctggcaggcatgcacctgcccagtgggcgtggcctgtgactccgtgagcggcgagtgtgggaagcggtgtcctgctggcttccagggagaggactgtggccaagagtgcccggtggggacgtttggcgtgaactgctcgagctcctgctcctgtgggggggccccctgccacggggtcacggggcagtgccggtgtccaccggggaggactggggaagactgtgaggcagattgtcccgagggccgctgggggctgggctgccaggagatctgcccagcatgccagcacgctgcccgctgcgaccctgagaccggagcctgcctgtgcctccctggcttcgtcggcagccgctgccaggacgtgtgcccagcaggctggtatggtcccagctgccagacaaggtgctcttgtgccaatgatgggcactgccacccagccaccggacactgcagctgtgcccccgggtggaccggctttagctgccagagagcctgtgatactgggcactggggacctgactgcagccacccctgcaactgcagcgctggccacgggagctgtgatgccatcagcggcctgtgtctgtgtgaggctggctacgtgggcccgcggtgcgagcagcagtgtccccagggccactttgggcccggctgtgagcagctgtgccagtgtcagcatggagcagcctgtgaccacgtcagcggggcctgcacctgcccggccggctggaggggcaccttctgcgagcatgcctgcccggccggcttctttggattggactgtcgtagtgcctgcaactgcaccgccggagctgcctgtgatgccgtgaatggctcctgcctctgccccgctggccgccggggcccccgctgtgccgagacctgccctgccggcctgtacggcgacaactgtcggcattcctgcctctgccagaacggagggacctgtgaccctgtctcaggccactgtgcgtgcccagagggctgggccggcctggcctgtgagaaggagtgccccccccgggacgtcagagctggctgccggcacagcggtggttgcctcaacgggggcctgtgtgacccgcacacgggccgctgcctctgcccagccggctgggctggggacaagtgtcagagcccctgcctgcggggctggtttggagaggcctgtgcccagcactgcagctgcccgcctggcgctgcctgccaccacgtcactggggcctgccgctgtccccctggcttcactggctccggctgcgagcagggatgtccgcccgggcggtatgggccaggctgtgaacagctgtgtgggtgtctcaacgggggctcctgtgatgcggccacgggggcctgccgctgccccactgggttcctcgggacggactgcaacctcacctgtccgcagggccgcttcggccccaactgcacccacgtgtgtgggtgtgggcagggggcggcctgcgaccctgtgaccggcacctgcctctgccccccggggagagccggcgtccgctgtgagcgaggctgcccccagaaccggtttggcgtgggctgcgagcacacctgctcctgcagaaatgggggcctgtgccacgccagcaacggcagctgctcctgtggcctgggctggacggggcggcactgcgagctggcctgtccccctgggcgctacggagccgcctgccatctggagtgctcctgccacaacaacagcacgggtgagcctgccacgggcacctgccgctgcggccccggcttctatggccaggcctgcgagcacccctgtccccctggcttccacggggctggctgccaggggttgtgctggtgtcaacatggagccccctgcgaccccatcagtggccgatgcctctgccctgccggcttccacggccacttctgtgagagggggtgtgagccaggttcatttggagagggctgccaccagcgctgtgactgtgacgggggggcaccctgtgaccctgtcaccggtctctgcctttgcccaccagggcgctcaggagccacctgtaacctggattgcagaaggggccagtttgggcccagctgcaccctgcactgtgactgcgggggtggggctgactgcgaccctgtcagtgggcagtgtcactgtgtggatggctacatggggcccacgtgccgggaaggtgggcccctccggctccccgagaacccgtccttagcccagggctcagcgggcacactgcccgcctccagcagacccacatcccggagcggtggaccagcgaggcactagtagaggcagtcccgtggagcccgcctctccagtcccagccagaggggaccctggcctttggtgaccactgagaaggacacttcacgggcccagagctcctggtactgcccttcctttgagggccgtggagggctgtggacagcccagcaacctgtcgctcttggaggctggtgtggccttgaggagggaagcctcgcatggccgctggaagagaggcgcctcctggcctggctctgcagaacccaggggcacgctctgggcctgggctgaggaagtcccgctctccccgcggctctgagttggactgaggacaggtgtgggcgccagtgtgggtgcaggcgcaggtgcaggcacagggccactgtcctccaggcaggctt

SEQ ID NO: 48 - protein, 1450 aa, Homo sapiens
MPMGHSDRWSWRLLRLALPLPVWLPAGGGRGADSPCLCSRPHVCAEQELTLVGRRQPCVQALSHTVPVWKAGCGWQAWCVGHERRTVYYMGYRQVYTTEARTVLRCCRGWTQQPDEEGCLSAECSASLCFHGGRCVPGSAQPCHCPPGFQGPRCQYDVDECRTHNGGCQHRCVNTPGSYLCECKPGFRLHTDSRTCLAINSCALGNGGCQHHCVQLTITRHRCQCRPGFQLQEDGRHCVRRSPCANRNGSCMHRCQVVRGLARCECHVGYQLAADGKACEDVDECAAGLAQCAHGCLNTQGSFKCVCHAGYELGADGRQCYRIEMEIVNSCEANNGGCSHGCSHTSAGPLCTCPRGYELDTDQRTCIRCRRLCRQPVLQQVCTNNPGGYECGCYAGYRLSADGCGCEDVDECASSRGGCEHHCTNLAGSFQCSCEAGYRLHEDRRGCSALEEPMVDLDGELPFVRPLPHIAVLQDELPQLFQDDDVGADEEEAELRGEHTLTEKFVCLDDSFGHDCSLTCDDCRNGGTCLLGLDGCDCPEGWTGLICNESCPPDTFGKNCSFSCSCQNGGTCDSVTGACRCPPGVSGTNCEDGCPKGYYGKHCRKKCNCANRGRCHRLYGACLCDPGLYGRFCHLACPPWAFGPGCSEECQCVQPHTQSCDKRDGSCSCKAGFRGERCQAECELGYFGPGCWQACTCPVGVACDSVSGECGKRCPAGFQGEDCGQECPVGTFGVNCSSSCSCGGAPCHGVTGQCRCPPGRTGEDCEADCPEGRWGLGCQEICPACQHAARCDPETGACLCLPGFVGSRCQDVCPAGWYGPSCQTRCSCANDGHCHPATGHCSCAPGWTGFSCQRACDTGHWGPDCSHPCNCSAGHGSCDAISGLCLCEAGYVGPRCEQQCPQGHFGPGCEQLCQCQHGAACDHVSGACTCPAGWRGTFCEHACPAGFFGLDCRSACNCTAGAACDAVNGSCLCPAGRRGPRCAETCPAGLYGDNCRHSCLCQNGGTCDPVSGHCACPEGWAGLACEKECPPRDVRAGCRHSGGCLNGGLCDPHTGRCLCPAGWAGDKCQSPCLRGWFGEACAQHCSCPPGAACHHVTGACRCPPGFTGSGCEQGCPPGRYGPGCEQLCGCLNGGSCDAATGACRCPTGFLGTDCNLTCPQGRFGPNCTHVCGCGQGAACDPVTGTCLCPPGRAGVRCERGCPQNRFGVGCEHTCSCRNGGLCHASNGSCSCGLGWTGRHCELACPPGRYGAACHLECSCHNNSTGEPATGTCRCGPGFYGQACEHPCPPGFHGAGCQGLCWCQHGAPCDPISGRCLCPAGFHGHFCERGCEPGSFGEGCHQRCDCDGGAPCDPVTGLCLCPPGRSGATCNLDCRRGQFGPSCTLHCDCGGGADCDPVSGQCHCVDGYMGPTCREGGPLRLPENPSLAQGSAGTLPASSRPTSRSGGPARH

SEQ ID NO: 49 - DNA, 877 bp, Homo sapiens
  CDS (25)..(534)
ccggagctgcctgtgatgccgtgaatggctcctgcctctgccccgctggccgccggggcccccgctgtgccgagacctgccctgccggcctgtacggcgacaactgtcggcattcctgcctctgccagaacggagggacctgtgaccctgtctcaggcctgcgagcacccctgtccccctggcttccacggggctggccgccaggggttgtgctggtgtcaacatggagccccctgcgaccccatcagtggccgatgcctctgccctgccggcttccacggccacttctgtgagagggattgcagaaggggccagtttgggcccagctgcaccctgcactgtgactgcgggggtggggctgactgcgaccctgtcagtgggcagtgtcactgtgtggatggctacatggggcccacgtgccgggaaggtgggcccctccggctccccgagaacccgtccttagcccagggctcagcgggcacactgcccgcctccagcagacccacatcccggagcggtggaccagcgaggcactagtagaggcagtcccgtggagcccgcctctccagtcccagccagaggggaccctggcctttggtgaccactgagaaggacacttcacgggcccagagctcctggtactgcccttcctttgagggccgtggagggctgtggacagcccagcaacctgtcgctcttggaggctggtgtggccttgaggagggaagcctcgcatggccgctggaagagaggcgtctcctggcctggctctgcagaacccaggggcacgctctgggcctgggctgaggaagtcccgctctcccgcggctctgagttggactgaggacaggtgtgggcgccagtgtgggtgcaggcg

SEQ ID NO: 50 - protein, 170 aa, Homo sapiens
MAPASAPLAAGAPAVPRPALPACTATTVGIPASARTEGPVTLSQACEHPCPPGFHGAGRQGLCWCQHGAPCDPISGRCLCPAGFHGHFCERDCRRGQFGPSCTLHCDCGGGADCDPVSGQCHCVDGYMGPTCREGGPLRLPENPSLAQGSAGTLPASSRPTSRSGGPARH

SEQ ID NO: 51 - DNA, 7334 bp, Homo sapiens
  CDS (1)..(4209)
  misc_feature (6031): Wherein "n" is A, or T, or C, or G.
  misc_feature (7259): Wherein "n" is A, or T, or C, or G.
atgcccatgggacattctgacaggtggtcttggcgtctcctgaggctggcactgccactcccagtctggttgccggctgggggtggccgaggcgctgactctccatgtctctgttccaggccccacgtgtgtgctgagcaggagctgaccctggtgggccgccgccagccgtgcgtgcaggccttaagccacacggtgccggtgtggaaggccggctgtgggtggcaggcgtggtgcgtgggtcatgagcggaggaccgtctactacatgggctacaggcaggtgtataccacggaggcccggaccgtgctcaggtgctgccgagggtggatgcagcagcccgacgaggagggctgcctctcggatgtgggtgagtgtgccaacgccaacgggggctgtgcgggtcggtgccgggacaccgtggggggcttctactgccgctggcccccccccagccaccagctgcagggtgatggcgagacttgccaagatgtggacgaatgccgaacccacaacggtggctgccagcaccggtgcgtgaacaccccaggctcctacctctgtgagtgcaagcccggcttccggctccacactgacagcaggacctgcgccattaactcctgcgccctgggcaatggcggctgccagcaccactgtgtccagctcacaatcactcggcatcgctgccagtgccggcccgggttccagctccaggaggacggcaggcattgtgtccgtagaagcccgtgtgccaacaggaacggcagctgcatgcacaggtgccaggtggtccggggcctcgcccgctgtgagtgccacgtgggctatcagctagcagcggacggcaaggcctgtgaagatgtggacgaatgtgccgcagggctggcccagtgtgcccatggctgcctcaacacccaggggtccttcaagtgcgtgtgtcacgcgggctatgagctgggcgccgatggccggcagtgctaccgtattgagatggaaatcgtgaacagctgtgaggccaacaacggcggctgctcccatggctgcagccacaccagtgctgggcccctgtgcacctgtccccgcggctacgagctggacacagatcagaggacctgcatcagatgtcgacgactgtgcagacagcccgtgctgcagcaggtgtgcaccaacaaccctggcgggtacgagtgcggctgctacgccggctaccggctcagtgccgatggctgcggctgcgaggatgtggatgagtgcgcctccagccgtggcggctgcgagcaccactgcaccaacctggccggctccttccagtgctcctgcgaggccggctaccggctgcacgaggaccgtaggggctgcagcgccctggaggagccgatggtggacctggacggcgagctgcctttcgtgcggcccctgccccacattgccgtgctccaggacgagctgccgcaactcttccaggatgacgacgtcggggccgatgaggaagaggcagagttgcggggcgaacacacgctcacagagaagtttgtctgcctggatgactcctttggccatgactgcagcttgacctgtgatgactgcaggaacggagggacctgcctcctgggcctggatggctgtgattgccccgagggctggactgggctcatctgcaatgagagttgtcctccggacacctttgggaagaactgcagcttctcctgcagctgtcagaatggtgggacctgcgactctgtcacgggggcctgccgctgccccccgggtgtcagtggaactaactgtgaggatggctgccccaagggctactatggcaagcactgtcgcaagaaatgcaactgtgccaaccggggccggtgccaccgcctctacggggcctgcctctgcgacccagggctctacggccgcttctgccacctcgcctgcccgccgtgggcctttgggccgggctgctcggaggagtgccagtgtgtgcagccccacacgcagtcctgtgacaagagggatggcagctgctcctgcaaggctggcttccggggcgagcgctgtcaggcagagtgtgagccgggctactttgggccggggtgctggcaggcatgcacctgcccagtgggcgtggcctgtgactccgtgagcggcgagtgtgggaagcggtgtcctgctggcttccagggagaggactgtggccaagagtgcccggtggggacctttggcgtgaactgctcgagctcctgctcctgtgggggggccccctgccacggggtcacggggcagtgccggtgtccgccggggaggactggggaagactgtgaggcaggtgagtgtgagggcctctgggggctgggctgccaggagatctgcccagcatgccataacgctgctcgctgcgaccctgagaccggagcctgcctgtgcctccctggctttgtcggcagccgctgccaggactgtgaggcaggctggtatggtcccagctgccagacaatgtgctcttgtgccaatgatgggcactgccaccaagacacgggacactgcagctgtgcccccgggtggaccggctttagctgccagagagcctgtgatactgggcactggggacctgactgcagccacccctgcaactgcagcgctggccacgggagctgtgatgccatcagcggcctgtgtctgtgtgaggctggctacgtgggcccgcggtgcgagcagtcagagtgtccccagggccactttgggcccggctgtgagcagcggtgccagtgtcagcatggagcagcctgtgaccacgtcagcggggcctgcacctgcccggccggctggaggggcaccttctgcgagcatgcctgcccggccggcttctttggattggactgtcgcagtgcctgcaactgcaccgccggagctgcctgtgatgccgtgaatggctcctgcctctgccccgctggccgccggggcccccgctgtgccgagacctgcccagcccacacctacgggcacaattgcagccaggcctgtgcctgctttaacggggcctcctgtgaccctgtccacgggcagtgccactgtgcccctggctggatggggccctcctgcctgcaggcctgccctgccggcctgtacggcgacaactgtcggcattcctgcctctgccagaacggagggacctgtgaccctgtctcaggccactgtgcgtgcccagagggctgggccggcctggcctgtgaggtagagtgcctcccccgggacgtcagagctggctgccggcacagcggcggttgcctcaacgggggcctgtgtgacccgcacacgggccgctgcctctgcccagccggctggactggggacaagtgtcagagccctgcagcctgtgccaagggcacattcgggcctcactgtgaggggcgctgtgcctgccggtggggaggcccctgccaccttgccaccggggcctgcctctgccctccggggtggcgggggcctcatctttctgcagcctgcctgcggggctggtttggagaggcctgtgcccagcgctgcagctgcccgcctggcgctgcctgccaccacgtcactggggcctgccgctgtccccctggcttcactggctccggctgcgagcaggcctgcccacccggcagctttggggaggactgtgcgcagatgtgccagtgtcccggtgagaacccggcctgccaccctgccaccgggacctgctcatgtgctgctggctaccacggccccagctgccagcaacgatgtccgcccgggcggtatgggccaggctgtgaacagctgtgtgggtgtctcaacgggggctcctgtgatgcggccacgggggcctgccgctgccccactgggttcctcgggacggactgcaacctcacctgtccgcagggccgcttcggccccaactgcacccacgtgtgtgggtgtgggcagggggcggcctgcgaccctgtgaccggcacctgcctctgccccccggggagagccggcgtccgctgtgagcgaggctgcccccagaaccggtttggcgtgggctgcgagcacacctgctcctgcagaaatgggggcctgtgccacgccagcaagcggcagctgctcctgtggcctgggctggacggggcggcactgcgagctggcctgtccccctgggcgctacggagccgcctgccatctggagtgctcctgccacaacaacagcacgtgtgagcctgccacgggcacctgccgctgcggccccggcttctatggccaggcctgcgagcacccctgtccccctggcttccacggggctggctgccaggggttgtgctggtgtcaacatggagccccctgcgaccccatcagtggccgatgcctctgccctgccggcttccacggccacttctgtgagagggggtgtgagccaggttcatttggagagggctgccaccagcgctgtgactgtgacgggggggcaccctgtgaccctgtcaccggtctctgcctttgcccaccagggcgctcaggagccacctgtaacctggattgcagaaggggccagtttgggcccagctgcaccctgcactgtgactgcgggggtggggctgactgcgaccctgtcagtgggcagtgtcactgtgtggatggctacatggggcccacgtgccgggaaggtgggcccctccggctccccgagaacccgtccttagcccagggctcagcgggcacactgcccgcctccagcagacccacatcccggagcggtggaccagcgaggcactagtagaggcagtcccgtggagcccgcctctccagtcccagccagaggggaccctggcctttggtgaccactgagaaggacacttcacgggcccagagctcctggtactgcccttcctttgagggccgtggagggctgtggacagcccagcaacctgtcgctcttggaggctggtgtggccttgaggagggaagcctcgcatggccgctggaagagaggcgcctcctggcctggctctgcagaacccaggggcacgctctgggcctgggctgaggaagtcccgctctccccgcggctctgagttggactgaggacaggtgtgggcgccagtgtgggtgcaggcgcaggtgcaggcacagggccactgtcctccaggcaggctttttggtgctaggccctgggactggaagtcgcccagcccgtatttatgtaaaggtatttatgggccactgcacatgcccgctgcagccctgggatcagctggaagctgcctgtcatctcctgcccaatccccagaaaccctgattcaggtctgcaggctcctgcgggctcaccaggctgctggctccggtaccatgtaaacctaggaaggtaaaggagcaggcaacctcctcgtggcctgtgtgtttgctgtgttacgtggactctgtgtgggctcctccctggggcccggccagcataacggtgcacccagggacctcccagtgcacccggggccctttgcaggggtgggggtgccacacaagtgaagaagttgggactcatctcagttcccagtgctattgaggagaacgctggggctgcattcattaccgctgagacccagagactggctgttcccagagaatggcccagggggaggagggctggtgtggaggggcaacctggactgaggccgaactcccttgggctcaccccacccacccctacctgagcatcagcagtggggggagggcagcatcgcaggggcagggactccctgggtgaggacagaccagccctcccgagcacctggcactcatgggctgaggctgacttctcctggaagaagggcccagagtggaaggaagaggcagagggtagaggtggtggctgggggctcctctgcagagtggggtggccaatggagagggctgcactcacaccgcaacataggactctctctcccttaagaaggcccccttagggtctgggctgccgcccccatcaccctaaaaccagccaaggtagctgaggccccagggcagacaatttcaccagcaggangaggaggagtccagtgagcttggttgctcacagacagcaagggagctgtcacagaggaagctgatgaatggaccgctgtggggagactttaaagtagaacagtgataagggagggcaggatggtggggatgcagaagcagcagccagagagagacggactggggtgcagacggagtgtggaaaacgcataccttgaaatgaagcatccagcagatggggtgagtggatacagctcaggagattctcccaggaatagcagggaggcgtaaagagagacaacgtacagagatagatgaatggaaatgggtaagggaggtgttcattcacatccatctaactgcaaaatacaaaagtaagaagtcattgacatgaagcaacgacgaccaagacgttctcagatctaaaggtgaatgatctcagtcagcctggaaatgcacaaggtggaaaaataacataaaaaagccataagaccttgaagaacatcaatgtcaaagataaattctaaagtcccagagaaaaaagaatgggaatcaaattgacctcagactatacgtgagaaacacggagagccagaaaactgtgatgttccatcctcagagtttgaaggaaatatttgaaggctgaattttacatccagctaaactatcaaaggcatgcaaagtccatgttattcttaggccttcaaggcctcggccatttttctacagaaaagcctgattttaaaatgctcttagagacgttctccagccagaagagaaagaagccaggagggtgctctgagatattcagtcaccacagttcccaaatggcctaggaattcagagagtcagaatatcaccattactccccaatgggaacccccgacagtctcagcatggtgtgagggtgtggacggggggcctggcaggtaccaatcactcatcccgctcagtgaagacacagtgttcagctacggaagccataaggcaggccgagcttctgcccatccggaggaaatctcagctatccaacggcggtcaggagcagaggaaaataaagcagaataactagaaaacacgctcacagatcctaatgttaacggttacaaatgacgacggaaaaacaaactcctgaccatatattatatagtttcaagcagcaagaaggaggatattgaacattctcaacacacataataaacgcttgagatgatgatatgctcattaccctgatttgatcactagacatnccatgtatcaaaacatcactgtgtatccgatgaatatctacaattattgtcaattaaaaacatcattaaaaacaa

SEQ ID NO: 52 - protein, 1403 aa, Homo sapiens
MPMGHSDRWSWRLLRLALPLPVWLPAGGGRGADSPCLCSRPHVCAEQELTLVGRRQPCVQALSHTVPVWKAGCGWQAWCVGHERRTVYYMGYRQVYTTEARTVLRCCRGWMQQPDEEGCLSDVGECANANGGCAGRCRDTVGGFYCRWPPPSHQLQGDGETCQDVDECRTHNGGCQHRCVNTPGSYLCECKPGFRLHTDSRTCAINSCALGNGGCQHHCVQLTITRHRCQCRPGFQLQEDGRHCVRRSPCANRNGSCMHRCQVVRGLARCECHVGYQLAADGKACEDVDECAAGLAQCAHGCLNTQGSFKCVCHAGYELGADGRQCYRIEMEIVNSCEANNGGCSHGCSHTSAGPLCTCPRGYELDTDQRTCIRCRRLCRQPVLQQVCTNNPGGYECGCYAGYRLSADGCGCEDVDECASSRGGCEHHCTNLAGSFQCSCEAGYRLHEDRRGCSALEEPMVDLDGELPFVRPLPHIAVLQDELPQLFQDDDVGADEEEAELRGEHTLTEKFVCLDDSFGHDCSLTCDDCRNGGTCLLGLDGCDCPEGWTGLICNESCPPDTFGKNCSFSCSCQNGGTCDSVTGACRCPPGVSGTNCEDGCPKGYYGKHCRKKCNCANRGRCHRLYGACLCDPGLYGRFCHLACPPWAFGPGCSEECQCVQPHTQSCDKRDGSCSCKAGFRGERCQAECEPGYFGPGCWQACTCPVGVACDSVSGECGKRCPAGFQGEDCGQECPVGTFGVNCSSSCSCGGAPCHGVTGQCRCPPGRTGEDCEAGECEGLWGLGCQEICPACHNAARCDPETGACLCLPGFVGSRCQDCEAGWYGPSCQTMCSCANDGHCHQDTGHCSCAPGWTGFSCQRACDTGHWGPDCSHPCNCSAGHGSCDAISGLCLCEAGYVGPRCEQSECPQGHFGPGCEQRCQCQHGAACDHVSGACTCPAGWRGTFCEHACPAGFFGLDCRSACNCTAGAACDAVNGSCLCPAGRRGPRCAETCPAHTYGHNCSQACACFNGASCDPVHGQCHCAPGWMGPSCLQACPAGLYGDNCRHSCLCQNGGTCDPVSGHCACPEGWAGLACEVECLPRDVRAGCRHSGGCLNGGLCDPHTGRCLCPAGWTGDKCQSPAACAKGTFGPHCEGRCACRWGGPCHLATGACLCPPGWRGPHLSAACLRGWFGEACAQRCSCPPGAACHHVTGACRCPPGFTGSGCEQACPPGSFGEDCAQMCQCPGENPACHPATGTCSCAAGYHGPSCQQRCPPGRYGPGCEQLCGCLNGGSCDAATGACRCPTGFLGTDCNLTCPQGRFGPNCTHVCGCGQGAACDPVTGTCLCPPGRAGVRCERGCPQNRFGVGCEHTCSCRNGGLCHASKRQLLLWPGLDGAALRAGLSPWALRSRLPSGVLLPQQQHV

SEQ ID NO: 53 - DNA, 4835 bp, Homo sapiens
  CDS (1)..(4731)
atgtcgttccttgaagaggcgagggcagcggggcgcgcggtggtcctggcgttggtgctgctgctgctccccgccgtgcccgtgggcgccagcgttccgccgcggcccctgctcccgctgcagcccggcatgccccacgtgtgtgctgagcaggagctgaccctggtgggccgccgccagccgtgcgtgcaggccttaagccacacggtgccggtgtggaaggccggctgtgggtggcaggcgtggtgcgtgggtcatgagcggaggaccgtctactacatgggctacaggcaggtgtataccacggaggcccggaccgtgctcaggtgctgccgagggtggatgcagcagcccgacgaggagggctgcctctcggatgtgggtgagtgtgccaacgccaacgggggctgtgcgggtcggtgccgggacaccgtggggggcttctactgccgctggcccccccccagccaccagctgcagggtgatggcgagacttgccaagatgtggacgaatgccgaacccacaacggtggctgccagcaccggtgcgtgaacaccccaggctcctacctctgtgagtgcaagcccggcttccggctccacactgacagcaggacctgcgccattaactcctgcgccctgggcaatggcggctgccagcaccactgtgtccagctcacaatcactcggcatcgctgccagtgccggcccgggttccagctccaggaggacggcaggcattgtgtccgtagaagcccgtgtgccaacaggaacggcagctgcatgcacaggtgccaggtggtccggggcctcgcccgctgtgagtgccacgtgggctatcagctagcagcggacggcaaggcctgtgaagatgtggacgaatgtgccgcagggctggcccagtgtgcccatggctgcctcaacacccaggggtccttcaagtgcgtgtgtcacgcgggctatgagctgggcgccgatggccggcagtgctaccgtattgagatggaaatcgtgaacagctgtgaggccaacaacggcggctgctcccatggctgcagccacaccagtgctgggcccctgtgcacctgtccccgcggctacgagctggacacagatcagaggacctgcatcagatgtcgacgactgtgcagacagcccgtgctgcagcaggtgtgcaccaacaaccctggcgggtacgagtgcggctgctacgccggctaccggctcagtgccgatggctgcggctgcgaggatgtggatgagtgcgcctccagccgtggcggctgcgagcaccactgcaccaacctggccggctccttccagtgctcctgcgaggccggctaccggctgcacgaggaccgtaggggctgcagcgccctggaggagccgatggtggacctggacggcgagctgcctttcgtgcggcccctgccccacattgccgtgctccaggacgagctgccgcaactcttccaggatgacgacgtcggggccgatgaggaagaggcagagttgcggggcgaacacacgctcacagagaagtttgtctgcctggatgactcctttggccatgactgcagcttgacctgtgatgactgcaggaacggagggacctgcctcctgggcctggatggctgtgattgccccgagggctggactgggctcatctgcaatgagagttgtcctccggacacctttgggaagaactgcagcttctcctgcagctgtcagaatggtgggacctgcgactctgtcacgggggcctgccgctgccccccgggtgtcagtggaactaactgtgaggatggctgccccaagggctactatggcaagcactgtcgcaagaaatgcaactgtgccaaccggggccggtgccaccgcctctacggggcctgcctctgcgacccagggctctacggccgcttctgccacctcgcctgcccgccgtgggcctttgggccgggctgctcggaggagtgccagtgtgtgcagccccacacgcagtcctgtgacaagagggatggcagctgctcctgcaaggctggcttccggggcgagcgctgtcaggcagagtgtgagccgggctactttgggccggggtgctggcaggcatgcacctgcccagtgggcgtggcctgtgactccgtgagcggcgagtgtgggaagcggtgtcctgctggcttccagggagaggactgtggccaagagtgcccggtggggacctttggcgtgaactgctcgagctcctgctcctgtgggggggccccctgccacggggtcacggggcagtgccggtgtccgccggggaggactggggaagactgtgaggcaggtgagtgtgagggcctctgggggctgggctgccaggagatctgcccagcatgccataacgctgctcgctgcgaccctgagaccggagcctgcctgtgcctccctggctttgtcggcagccgctgccaggactgtgaggcaggctggtatggtcccagctgccagacaatgtgctcttgtgccaatgatgggcactgccaccaagacacgggacactgcagctgtgcccccgggtggaccggctttagctgccagagagcctgtgatactgggcactggggacctgactgcagccacccctgcaactgcagcgctggccacgggagctgtgatgccatcagcggcctgtgtctgtgtgaggctggctacgtgggcccgcggtgcgagcagtcagagtgtccccagggccactttgggcccggctgtgagcagcggtgccagtgtcagcatggagcagcctgtgaccacgtcagcggggcctgcacctgcccggccggctggaggggcaccttctgcgagcatgcctgcccggccggcttctttggattggactgtcgcagtgcctgcaactgcaccgccggagctgcctgtgatgccgtgaatggctcctgcctctgccccgctggccgccggggcccccgctgtgccgagagtgcctgcccagcccacacctacgggcacaattgcagccaggcctgtgcctgctttaacggggcctcctgtgaccctgtccacgggcagtgccactgtgcccctggctggatggggccctcctgcctgcaggcctgccctgccggcctgtacggcgacaactgtcggcattcctgcctctgccagaacggagggacctgtgaccctgtctcaggccactgtgcgtgcccagagggctgggccggcctggcctgtgaggtagagtgcctcccccgggacgtcagagctggctgccggcacagcggcggttgcctcaacgggggcctgtgtgacccgcacacgggccgctgcctctgcccagccggctggactggggacaagtgtcagagccctgcagcctgtgccaagggcacattcgggcctcactgtgaggggcgctgtgcctgccggtggggaggcccctgccaccttgccaccggggcctgcctctgccctccggggtggcgggggcctcatctttctgcagcctgcctgcggggctggtttggagaggcctgtgcccagcgctgcagctgcccgcctggcgctgcctgccaccacgtcactggggcctgccgctgtccccctggcttcactggctccggctgcgagcaggcctgcccacccggcagctttggggaggactgtgcgcagatgtgccagtgtcccggtgagaacccggcctgccaccctgccaccgggacctgctcatgtgctgctggctaccacggccccagctgccagcaacgatgtccgcccgggcggtatgggccaggctgtgaacagctgtgtgggtgtctcaacgggggctcctgtgatgcggccacgggggcctgccgctgccccactgggttcctcgggacggactgcaacctcacctgtccgcagggccgcttcggccccaactgcacccacgtgtgtgggtgtgggcagggggcggcctgcgaccctgtgaccggcacctgcctctgccccccggggagagccggcgtccgctgtgagcgaggctgcccccagaaccggtttggcgtgggctgcgagcacacctgctcctgcagaaatgggggcctgtgccacgccagcaacggcagctgctcctgtggcctgggctggacggggcggcactgcgagctggcctgtccccctgggcgctacggagccgcctgccatctggagtgctcctgccacaacaacagcacgtgtgagcctgccacgggcacctgccgctgcggccccggcttctatggccaggcctgcgagcacccctgtccccctggcttccacggggctggctgccaggggttgtgctggtgtcaacatggagccccctgcgaccccatcagtggccgatgcctctgccctgccggcttccacggccacttctgtgagagggggtgtgagccaggttcatttggagagggctgccaccagcgctgtgactgtgacgggggggcaccctgtgaccctgtcaccggtctctgcctttgcccaccagggcgctcaggagccacctgtaacctggattgcagaaggggccagtttgggcccagctgcaccctgcactgtgactgcgggggtggggctgactgcgaccctgtcagtgggcagtgtcactgtgtggatggctacatggggcccacgtgccgggaagcgggcacactgcccgcctccagcagacccacatcccggagcggtggaccagcgaggcactagtagaggcagtcccgtggagcccgcctctccagtcccagccagaggggaccctggcctttggtgaccactgagaaggacacttcacgggcccagagctcctg

SEQ ID NO: 54 - protein, 1577 aa, Homo sapiens
MSFLEEARAAGRAVVLALVLLLLPAVPVGASVPPRPLLPLQPGMPHVCAEQELTLVGRRQPCVQALSHTVPVWKAGCGWQAWCVGHERRTVYYMGYRQVYTTEARTVLRCCRGWMQQPDEEGCLSDVGECANANGGCAGRCRDTVGGFYCRWPPPSHQLQGDGETCQDVDECRTHNGGCQHRCVNTPGSYLCECKPGFRLHTDSRTCAINSCALGNGGCQHHCVQLTITRHRCQCRPGFQLQEDGRHCVRRSPCANRNGSCMHRCQVVRGLARCECHVGYQLAADGKACEDVDECAAGLAQCAHGCLNTQGSFKCVCHAGYELGADGRQCYRIEMEIVNSCEANNGGCSHGCSHTSAGPLCTCPRGYELDTDQRTCIRCRRLCRQPVLQQVCTNNPGGYECGCYAGYRLSADGCGCEDVDECASSRGGCEHHCTNLAGSFQCSCEAGYRLHEDRRGCSALEEPMVDLDGELPFVRPLPHIAVLQDELPQLFQDDDVGADEEEAELRGEHTLTEKFVCLDDSFGHDCSLTCDDCRNGGTCLLGLDGCDCPEGWTGLICNESCPPDTFGKNCSFSCSCQNGGTCDSVTGACRCPPGVSGTNCEDGCPKGYYGKHCRKKCNCANRGRCHRLYGACLCDPGLYGRFCHLACPPWAFGPGCSEECQCVQPHTQSCDKRDGSCSCKAGFRGERCQAECEPGYFGPGCWQACTCPVGVACDSVSGECGKRCPAGFQGEDCGQECPVGTFGVNCSSSCSCGGAPCHGVTGQCRCPPGRTGEDCEAGECEGLWGLGCQEICPACHNAARCDPETGACLCLPGFVGSRCQDCEAGWYGPSCQTMCSCANDGHCHQDTGHCSCAPGWTGFSCQRACDTGHWGPDCSHPCNCSAGHGSCDAISGLCLCEAGYVGPRCEQSECPQGHFGPGCEQRCQCQHGAACDHVSGACTCPAGWRGTFCEHACPAGFFGLDCRSACNCTAGAACDAVNGSCLCPAGRRGPRCAESACPAHTYGHNCSQACACFNGASCDPVHGQCHCAPGWMGPSCLQACPAGLYGDNCRHSCLCQNGGTCDPVSGHCACPEGWAGLACEVECLPRDVRAGCRHSGGCLNGGLCDPHTGRCLCPAGWTGDKCQSPAACAKGTFGPHCEGRCACRWGGPCHLATGACLCPPGWRGPHLSAACLRGWFGEACAQRCSCPPGAACHHVTGACRCPPGFTGSGCEQACPPGSFGEDCAQMCQCPGENPACHPATGTCSCAAGYHGPSCQQRCPPGRYGPGCEQLCGCLNGGSCDAATGACRCPTGFLGTDCNLTCPQGRFGPNCTHVCGCGQGAACDPVTGTCLCPPGRAGVRCERGCPQNRFGVGCEHTCSCRNGGLCHASNGSCSCGLGWTGRHCELACPPGRYGAACHLECSCHNNSTCEPATGTCRCGPGFYGQACEHPCPPGFHGAGCQGLCWCQHGAPCDPISGRCLCPAGFHGHFCERGCEPGSFGEGCHQRCDCDGGAPCDPVTGLCLCPPGRSGATCNLDCRRGQFGPSCTLHCDCGGGADCDPVSGQCHCVDGYMGPTCREAGTLPASSRPTSRSGGPARH

SEQ ID NO: 55 - DNA, 990 bp, Homo sapiens
  CDS (3)..(944)
acatggagacaagaaattactctgccatgactgaattctttctggtggggctttcccaatatccagagctccagctttttctgttcctgctctgcctcatcatgtacatgataatcctcctgggaaatagcctcctcattatcatcaccatcttggattctcgcctccatactcccatgtatttctttcttggaaacctctcattcttggacatctgttacacatcctcatccattcctccaatgcttattatatttatgtctgagagaaaatccatctccttcattggctgtgctctgcagatggttatgtcccttggcttgggctccactgagtgtgtcctcctggctgtgatggcctatgaccactatgtggccatctgcaacccactgaggtactccatcatcatgaacggagtgctgtatgtgcaaatggctgcatggtcctggatcataggctgtctgacctccctattgcacacagttctgacaatgatgttgcctttctgtgggaataatgtcattgatcatattacctgtgaaattttggcccttctaaaacttgtttgttcagatatcaccatcaatgtgcttatcatgacagtgacaaatattgtttcactggtgattcttctactgttaattttcatctcctatgtgtttattctctcttccatcctgagaattaattgtgctgagggaagaaagaaagccttctctacctgttcagcgcactcgattgtggtcatcttattctacggttcagccctttttatgtacatgaaacccaagtcaaagaacactaatacatctgatgagattattgggctgtcttatggagtggtaagcccaatgttaaatcccatcatctatagcctcaggaataaagaggtcaaagaggctgtaaagaaagtcctgagcagacatctgcatttattgaaaatgtgaaaaaccttgggcatgcgatatcctcaatggggcaagagagctt

SEQ ID NO: 56 - protein, 314 aa, Homo sapiens
METRNYSAMTEFFLVGLSQYPELQLFLFLLCLIMYMIILLGNSLLIIITILDSRLHTPMYFFLGNLSFLDICYTSSSIPPMLIIFMSERKSISFIGCALQMVMSLGLGSTECVLLAVMAYDHYVAICNPLRYSIIMNGVLYVQMAAWSWIIGCLTSLLHTVLTMMLPFCGNNVIDHITCEILALLKLVCSDITINVLIMTVTNIVSLVILLLLIFISYVFILSSILRINCAEGRKKAFSTCSAHSIVVILFYGSALFMYMKPKSKNTNTSDEIIGLSYGVVSPMLNPIIYSLRNKEVKEAVKKVLSRHLHLLKM

SEQ ID NO: 57 - DNA, 1875 bp, Homo sapiens
  CDS (5)..(1822)
gctcatgcttatgggcggggtgacccacacatctgtgcccctctctgagcaggaggaggccccgtcgcagacgcgcgcgcagacagcgtctgccgcgggcacctggggccgcgcgccgcggggcgccccgcctccgctctccgaggcccaatcatctggaggctgtgggggcacgtcccgctcccggccacgcccccagccggcggggcgggggctcgcgtccctcgcgcttctccggcgcctgaggggcccgcctcgggccatggtgctctcccaggaggagccggactccgcgcggggcacgagcgaggcgcagccgctcggccccgcgcccacgggggccgctccgccgcccggcccgggaccctcggacagccccgaggcggctgtcgagaaggtggaggtggagctggcggggccggcgaccgcggagccccatgagccccccgaaccccccgagggcggctggggctggctggtgatgctggcggccatgtggtgcaacgggtcggtgttcggcatccagaacgcttgcggggtgctcttcgtgtccatgctggaaaccttcggctccaaagacgatgacaagatggtctttaagacagcatgggtaggttctctctccatggggatgattttcttttgctgcccaatagtcagcgtcttcacagacctatttggttgtcggaaaacagctgtcgtgggtgctgctgttggatttgttgggctcatgtccagttcttttgtaagttccatcgagcctctgtaccttacctatggaatcatatttgcctgcggctgctcctttgcataccagccttcattggtcattttgggacactatttcaagaagcgccttggactggtgaatggcattgtcactgctggcagcagtgtcttcacaatcctgctgcctttgctcttaagggttctgattgacagcgtgggcctcttttacacattgagggtgctctgcatcttcatgtttgttctctttctggctggctttacttaccgacctcttgctaccagtaccaaagataaagagagtggaggtagcggatcctccctcttttccaggaaaaagttcagtcctccaaaaaaaattttcaattttgccatcttcaaggtgacagcttatgcagtgtgggcagttggaataccacttgcactttttggatactttgtgccttatgttcacttggtgagtatgctccttcacaaacatgtaaatgaaagatttcaagatgaaaaaaataaagaggttgttctcatgtgcattggcgtcacttcaggagttggacgactgctctttggccggattgcagattatgtgcctggtgtgaagaaggtttatctacaggtactttcctttttcttcattggtctgatgtccatgatgattcctctgtgtagcatctttggggccctcattgctgtgtgcctcatcatgggtctcttcgatggatgcttcatttccattatggctcccatagcctttgagttagttggtgcccaggatgtctcccaagcaattggatttctgctcggattcatgtctatacccatgactgttggcccacccattgcaggtttacttcgtgacaaactgggctcctatgatgtggcattctacctcgctggagtccctccccttattggaggtgctgtgctttgttttatcccgtggatccatagtaagaagcaaagagagatcagtaaaaccactggaaaagaaaagatggagaaaatgttggaaaaccagaactctctgctgtcaagttcatctggaatgttcaagaaagaatctgactctattatttaatatcttacatacctccaccagactggacttgctttttgaattttaagcaa

SEQ ID NO: 58 - protein, 606 aa, Homo sapiens [sequence omitted]

SEQ ID NO: 59 - DNA, 1605 bp, Homo sapiens
  CDS (31)..(1575)
ctccggcgcctgaggggcccgcctcgggccatggtgctctcccaggaggagccggactccgcgcggggcacgagcgaggcgcagccgctcggccccgcgcccacgggggccgctccgccgcccggcccgggaccctcggacagccccgaggcggctgtcgagaaggtggaggtggagctggcggggccggcgaccgcggagccccatgagccccccgaaccccccgagggcggctggggctggctggtgatgctggcggccatgtggtgcaacgggtcggtgttcggcatccagaacgcttgcggggtgctcttcgtgtccatgctggaaaccttcggctccaaagacgatgacaagatggtctttaagacagcatgggtaggttctctctccatggggatgattttcttttgctgcccaatagtcagtgtcttcacagacctatttggttgtcggaaaacagctgtcgtgggtgctgctgttggatttgttgggctcatgtccagttcttttgtaagttccatcgagcctctgtaccttacctatggaatcatatttgcctgcggctgctcctttgcataccagccttcattggtcattttgggacactatttcaagaagcgccttggactggtgaatggcattgtcactgctggcagcagtgtcttcacaatcctgctgcctttgctcttaagggttctgattgacagcgtgggcctcttttacacattgagggtgctctgcatcttcatgtttgttctctttctggctggctttacttaccgacctcttgctaccagtaccaaagataaagagagtggaggtagcggatcctccctcttttccaggaaaaagttcagtcctccaaaaaaaattttcaattttgccatcttcaaggtgacagcttatgcagtgtgggcagttggaataccacttgcactttttggatactttgtgccttatgttcacttgatgaaacatgtaaatgaaagatttcaagatgaaaaaaataaagaggttgttctcatgtgcattggcgtcacttcaggagttggacgactgctctttggccggattgcagattatgtgcctggtgtgaagaaggtttatctacaggtactctcctttttcttcattggtctgatgtccatgatgattcctctgtgtagcatctttggggccctcattgctgtgtgcctcatcatgggtctcttcgatggatgcttcatttccattatggctcccatagcctttgagttagttggtgcccaggatgtctcccaagcaattggatttctgctcggattcatgtctatacccatgactgttggcccacccattgcaggtttacttcgtgacaaactgggctcctatgatgtggcattctacctcgctggagtccctccccttattggaggtgctgtgctttgttttatcccgtggatccatagtaagaagcaaagagagatcagtaaaaccactggaaaagaaaagatggagaaaatgttggaaaaccagaactctctgctgtcaagttcatctggaatgttcaagaaagaatctgactctattatttaatatcttacatacctccaccagactgga

SEQ ID NO: 60 - protein, 515 aa, Homo sapiens
MVLSQEEPDSARGTSEAQPLGPAPTGAAPPPGPGPSDSPEAAVEKVEVELAGPATAEPHEPPEPPEGGWGWLVMLAAMWCNGSVFGIQNACGVLFVSMLETFGSKDDDKMVFKTAWVGSLSMGMIFFCCPIVSVFTDLFGCRKTAVVGAAVGFVGLMSSSFVSSIEPLYLTYGIIFACGCSFAYQPSLVILGHYFKKRLGLVNGIVTAGSSVFTILLPLLLRVLIDSVGLFYTLRVLCIFMFVLFLAGFTYRPLATSTKDKESGGSGSSLFSRKKFSPPKKIFNFAIFKVTAYAVWAVGIPLALFGYFVPYVHLMKHVNERFQDEKNKEVVLMCIGVTSGVGRLLFGRIADYVPGVKKVYLQVLSFFFIGLMSMMIPLCSIFGALIAVCLIMGLFDGCFISIMAPIAFELVGAQDVSQAIGFLLGFMSIPMTVGPPIAGLLRDKLGSYDVAFYLAGVPPLIGGAVLCFIPWIHSKKQREISKTTGKEKMEKMLENQNSLLSSSSGMFKKESDSII

SEQ ID NO: 61 - DNA, 1001 bp, Homo sapiens
  CDS (37)..(957)
gtgttccatagattattttgtcttttgtctgaagtgatgctgaatacaacctcagtcaccgaatttctcctcttgggagtgacagacattcaagaactgcagccttttctcttcgtggttttcctcaccatctacttcatcagtgtgactgggaatggagccgttctgatgattgtcatctccgatcctagactccattcccttatgtatttcttcctgggaaacctgtcctacctggatatctgttactctacggtgacactgccaaaaatgctgcagaactttctctctacacacaaagcaatttctttcttgggatgcataagccagcttcatttcttccacttcctgggcagcacggagtccatgttgttcgccgtgatggcatttgacctctctgtggctatctgcaagccacttcgctacactgtcatcatgaaccctcagctctgtacccagatggccatcacaatctgggtcattggttttttccatgccctgctgcactccgtaatgacttctcgcttgaacttctgtggttccaaccgtatccatcattttctctgtgatattaagccattgctaaagctggcctgtgggaacactgagcttaatcagtggctactcagtactgtcacggggacaattgccatgggccccttctttctgacacttctctcctatttctacattatcacttatctcttcttcaagacccgttcttgtagcatgctctgtaaagcactgtccacttgtgcctcccacttcatggtagttattcttttctatgcacctgttcttttcacctatatccatcctgcgttagagagcttcatggaccaggaccggattgttgccatcatgtacactgtggtcactcctgtactaaacccactgatctatactttgaggaacaaggaagtgaagggggccttgggtagagtgatcagaaggctttgatttgaataaaccagagaactctactgaggcataaataacca

SEQ ID NO: 62 - protein, 307 aa, Homo sapiens
MLNTTSVTEFLLLGVTDIQELQPFLFVVFLTIYFISVTGNGAVLMIVISDPRLHSLMYFFLGNLSYLDICYSTVTLPKMLQNFLSTHKAISFLGCISQLHFFHFLGSTESMLFAVMAFDLSVAICKPLRYTVIMNPQLCTQMAITIWVIGFFHALLHSVMTSRLNFCGSNRIHHFLCDIKPLLKLACGNTELNQWLLSTVTGTIAMGPFFLTLLSYFYIITYLFFKTRSCSMLCKALSTCASHFMVVILFYAPVLFTYIHPALESFMDQDRIVAIMYTVVTPVLNPLIYTLRNKEVKGALGRVIRRL

SEQ ID NO: 63 - DNA, 1101 bp, Homo sapiens
taagcttctatacaacttctgaggtttggaagaagtacaacagtactctccttccaagtatctttggcttggtgagaaaattctgagccggaaggattctgattgcgattagtgttccatagattattttgtcttttgtctgaagtgatgctgaatacaacctcagtcaccgaatttctcctcttgggagtgacagacattcaagaactgcagccttttctcttcgtggttttcctcaccatctacttcatcagtgtgactgggaatggagccgttctgatgattgtcatctccgatcctagactccattcccttatgtatttcttcctgggaaacctgtcctacctggatatctgttactctacggtgacactgccaaaaatgctgcagaactttctctctacacacaaagcaatttctttcttgggatgcataagccagcttcatttcttccacttcctgggcagcacggagtccatgttgttcgccgtgatggcatttgacctctctgtggctatctgcaagccacttcgctacactgtcatcatgaaccctcagctctgtacccagatggccatcacaatctgggtcattggttttttccatgccctgctgcactccgtaatgacttctcgcttgaacttctgtggttccaaccgtatccatcattttctctgtgatattaagccattgctaaagctggcctgtgggaacactgagcttaatcagtggctactcagtactgtcacggggacaattgccatgggccccttctttctgacacttctctcctatttctacattatcacttatctcttcttcaagacccgttcttgtagcatgctctgtaaagcactgtccacttgtgcctcccacttcatggtagttattcttttctatgcacctgttcttttcacctatatccatcctgcgttagagagcttcatggaccaggaccggattgttgccatcatgtacactgtggtcactcctgtactaaacccactgatctatactttgaggaacaaggaagtgaagggggccttgggtagagtgatcagaaggctttgatttgaataaaccagagaactctactgaggc

SEQ ID NO: 64 - DNA, 2463 bp, Homo sapiens
  CDS (3)..(2105)
ggtgggcgagccgacacacgcccgccccgtctgggggcagcgccccctccccggcccgcccgcgccggctcctccgcagtgctttcagctgtgagcttgggcggcggcggcggcggcgctccactttcggggagcccggcggctctgggaagctcactcctccactcgtacccacactcgaccgcggagcccttgcagccatgagggaacagctcaaaggccacgagactcaaacaacttgctgggaccatcccaaaatgacagagctctaccagtctttagctgacctgaataatgtcagattctcagcttataggactgccatgaaactccgaagactgcagaaggccctttgctgggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagaaaccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaagttgtttataaaaac

SEQ ID NO: 65 - protein, 701 aa, Homo sapiens
WASRHTPAPSGGSAPSPARPRRLLRSAFSCELGRRRRRRSTFGEPGGSGKLTPPLVPTLDRGALAAMREQLKGHETQTTCWDHPKMTELYQSLADLNNVRFSAYRTAMKLRRLQKALCWDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRNLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGHNVGSLFHMADDLGRAMESLVSVMTDEEGAE

SEQ ID NO: 66 - DNA, 2005 bp, Homo sapiens
  CDS (53)..(1957)
gaagctcactcctccactcgtacccacactcgaccgcggagcccttgcagccatgagggaacagctcaaaggccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcggtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcgcaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggacacaatgtaggaagtcttttccacatggcagatgatttgggcagagcgatggagtccttagtatcagtcatgacagatgaagaaggagcagaataaatgttttacaactcctgattcccgcatggtttttataatattcat

SEQ ID NO: 67 - protein, 635 aa, Homo sapiens
MREQLKGHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGGNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGATVSSPSTSLQRSDSSQPMLLRVVGSQTSDSMGEEDLLSPPQDTSTGLEEVMEQLNNSFPSSRGHNVGSLFHMADDLGRAMESLVSVMTDEEGAE

SEQ ID NO: 68 - DNA, 1219 bp, Homo sapiens
  CDS (31)..(1050)
agcaggggcccagacgcgccaggcctggagatggctggaaactgctcctgggaggcccatcccggcaacaggaacaagatgtgccctggcctgagcgaggccccggaactctacagccggggcttcctgaccatcgagcagatcgcgatgctgccgcctccggccgtcatgaactacatcttcctgctcctctgcctgtgtggcctggtgggcaacgggctggtcctctggtttttcggcttctccatcaagaggaaccccttctccatctacttcctgcacctggccagcgccgatgtgggctacctcttcagcaaggcggtgttctccatcctgaacacggggggcttcctgggcacgtttgccgactacatccgcagcgtgtgccgggtcctggggctctgcatgttccttaccggcgtgagcctcctgccggccgtcagcgcgtcagcgtgcgcctcggtcatcttccccgcctggtactggcgccggcggcccaagcgcctgtcggccgtggtgtgcgccctgctgtgggtcctgtccctcctggtcacctgcctgcacaactacttctgcgtgttcctgggccgcggggccccgggcgcgtgctgcaggcacatggacatcttcctgggcatcctcctgttcctgctctgctgcccgctcatggtgctgccctgcctggccctcatcctgcacgtggagtgcgggcccgacgggccacgctctgccaagctcaagcacgtcatcctggccatggtctccgtcttcctggtgtcctccatctacttagggatcgactggttcctcttctgggtcttccagatcccggcccccttccccgagtacgtcactgacctgtgcatctgcatcaacagcagcgccaagcccatcgtctacttcctggccgggaggacaagtcgcagcggctgttggagccttagggtggtcttcagtggggcctgcgggacggcgctgactgggggatgtcggggcagcacgctcaacacagtcaccatggagatgcagtgtcccccggggaacgcctcctgagactgcagcgcctggaggaggcagtggcaggaatcgtgctccaagactcttctgctgtggacaggaatgggcactagttctgagtccatacaggagaggaaagatctgtatgctctcctcgggccttcttctccctgggactgtggaactcaggtagtgtctgggc

SEQ ID NO: 69 - protein, 340 aa, Homo sapiens
MAGNCSWEAHPGNRNKMCPGLSEAPELYSRGFLTIEQIAMLPPPAVMNYIFLLLCLCGLVGNGLVLWFFGFSIKRNPFSIYFLHLASADVGYLFSKAVFSILNTGGFLGTFADYIRSVCRVLGLCMFLTGVSLLPAVSASACASVIFPAWYWRRRPKRLSAVVCALLWVLSLLVTCLHNYFCVFLGRGAPGACCRHMDIFLGILLFLLCCPLMVLPCLALILHVECGPDGPRSAKLKHVILAMVSVFLVSSIYLGIDWFLFWVFQIPAPFPEYVTDLCICINSSAKPIVYFLAGRTSRSGCWSLRVVFSGACGTALTGGCRGSTLNTVTMEMQCPPGNAS

SEQ ID NO: 70 - DNA, 1113 bp, Homo sapiens
  CDS (73)..(1101)
atcaggacagctgcaggtgggtgtgcagactggtgagctgccagcaggggcccagacgcgccaggcctggagatggctggaaactgctcctgggaggcccatcccggcaacaggaacaagatgtgccctggcctgagcgaggccccggaactctacagccggggcttcctgaccatcgagcagatcgcgatgctgccgcctccggccgtcatgaactacatcttcctgctcctctgcctgtgtggcctggtgggcaacgggctggtcctctggtttttcggcttctccatcaagaggaaccccttctccatctacttcctgcacctggccagcgccgatgtgggctacctcttcagcaaggcggtgttctccatcctgaacacggggggcttcctgggcacgtttgccgactacatccgcagcgtgtgccgggtcctggggctctgcatgttccttaccggcgtgagcctcctgccggccgtcagcgccgagcgctgcgcctcggtcatcttccccgcctggtactggcgccggcggcccaagcgcctgtcggccgtggtgtgcgccctgctgtgggtcctgtccctcctggtcacctgcctgcacaactacttctgcgtgttcccgggccgcggggcccccggcgcggcctgcaggcacatggacatcttcctgggcatcctcctgttcctgctctgctgcccgctcatggtgctgccctgcctggccctcatcctgcacgtggagtgccgggcccgacggcgccagcgctctgccaagctcaaccacgtcatcctggccatggtctccgtcttcctggtgtcctccatctacttagggatcgactggttcctcttctgggtcttccagatcccggcccccttccccgagtacgtcactgacctgtgcatctgcatcaacagcagcgccaagcccatcgtctacttcctggccgggagggacaagtcgcagcggctgtgggagccgctcagggtggtcttccagcgggccctgcgggacggcgctgagctgggggaggccgggggcagcacgcccaacacagtcaccatggagatgcagtgtcccccggggaacgcctcctgagactccagc

SEQ ID NO: 71 - protein, 343 aa, Homo sapiens
MAGNCSWEAHPGNRNKMCPGLSEAPELYSRGFLTIEQIAMLPPPAVMNYIFLLLCLCGLVGNGLVLWFFGFSIKRNPFSIYFLHLASADVGYLFSKAVFSILNTGGFLGTFADYIRSVCRVLGLCMFLTGVSLLPAVSAERCASVIFPAWYWRRRPKRLSAVVCALLWVLSLLVTCLHNYFCVFPGRGAPGAACRHMDIFLGILLFLLCCPLMVLPCLALILHVECRARRRQRSAKLNHVILAMVSVFLVSSIYLGIDWFLFWVFQIPAPFPEYVTDLCICINSSAKPIVYFLAGRDKSQRLWEPLRVVFQRALRDGAELGEAGGSTPNTVTMEMQCPPGNAS

SEQ ID NO: 72 - DNA, 6921 bp, Homo sapiens
  CDS (61)..(6312)
atggaccaaggcccttggcggtgcgttgcgcacccccggggcgccgcgactgaagtagcaatggacgcgctggagtcgttgttggacgaagtcgctctggaggggctcgatggcctgtgtctgccagcgctgtggagccggctggagacgcgagtgccgcccttcccgctgcctttggaaccctgcacgcaggagtttctctggcgggccctcgccacgcacccgggcatcagcttctatgaggagcctcgggagcgacccgacctacagctccaggaccggtatgaagaaattgatttggaaactggaattttggagtctaggagggacccggtggctttggaggatgtctaccccattcatatgatcttagagaataaggatggcatccagggctcatgccgctactttaaggagaggaaaaacattaccaatgacatcagaaccaagtccttgcagcctcgctgtacaatggtggaaccctttgacaggtgggggaagaaactgatcatcggttccctcccagcccatgcggtacaggcccttgatagcccaggagggggatcccgacctgaagctgcccgacttctcctactgcatcctggaacggctaggccggtccaggtgcaaggggagctccagcgagaccttcacaccactgctttcaaggttgatgctgggaagctgcactatcacagaaaaattttgaacaaaaacgggctgattacaatgcagtcccatgtgatccgattacccactggagcccagcaacactcaatcctcctcctactgaaccggtttcatgtggacaggaggagcaaatacgacatcctcatggagaagctttcggtcatgctgagcacacggactaaccacatagagacgctgggaaagctgagggaagagctggggctgtgcgaaaggacgtttaagcgtctgtaccagtatatgctgaacgccgggctagccaaggtggtgtctcttcgcttgcaagagatccaccctgaatgtggaccttgtaagacaaagaaagggaccgacgtcatggttcggtgcctcaagctgctgaaggaatttaaacggaatgaccatgatgatgacgaggacgaggaggtcatctccaagacagtgcctccagtggacattgtgttcgagcgggatatgctcacacagacctacgacctcattgagcgcagaggcacgaaaggaatttcccaagctgaaatccgagtggctatgaatgtgggaaaactagaagcaagaatgctgtgccgacttcttcaaagattcaaagttgtcaagggattcatggaagacgaaggtcggcagcgaaccaccaagtacatttcctgcgtgtttgcagaggagagcgacctaagccggcagtaccaaagagagaaggcccgcagcgagctcttgaccaccgtgagcctggcgtctatgcaggaggagtcgcttctgcctgaaggcgaggacaccttcctctctgagtcggacagtgaggaggagaggagcagcagcaagcggagaggcagagggtcccagaaagacacaagagcctctgcaaacctccggcccaagacccagcctcatcactccaccccaaccaagggtgggtggaaagttgtaaacctacacccattgaaaaagcagccgccctccttcccaggagctgctgaagagagagcctgccagagccttgccagcagggacagcctcttagataccagcagcgtctcagaacccaacgtgtcctttgtctcccactgtgcggacagcaacagtggtgacatagctgtgatcgaggaggtccggatggaaaacccaaaggagagtagcagttccctgaagactgggaggcacagctcaggccaagacaaaccacacgaaacttaccgactgctgaaacgcaggaatctgatcatagaagctgtcaccaatcttcgcttaatcgagagtttattcacgattcagaagatgatcatggatcaggagaagcaggaaggcgtgtccaccaagtgctgcaagaagtccattgtccgcttggtgcggaacctgtctgaggaaggtctcttgcgattgtatcggaccactgtcattcaagatggcatcaagaagaaggtggatctggtggtgcacccgtccatggaccagaacgaccctctagtgagaagtgccatcgagcaggtccgcttccggatctccaattcaagcacagccaacagggttaaaacttcccagcctccagtgccccaaggggaggcagaagaagacagtcaaggaaaagagggcccaagtggatcaggggactctcagctgagtgcttcctctagatcagaaagtggacggatgaaaaaaagtgataataaaatgggcataaccccgcttagaaattatcaccccattgtagttcccggactggggcgttctctaggatttctgcccaaaatgcctcgcctgcgggtggtccacatgtttctgtggtacctcatctacgggcaccctgccagcaacaccgtggagaagccaagcttcatcagtgaacggagaacgataaagcaggagtcaggcagggcaggcgtccggccgtcctcctctggaagtgcctgggaggcctgctctgaagccccatctaaaggcagccaagatggtgtcacctgggaggctgaagtggagcttgccacggagacagtgtatgtcgacgatgcctcgtggatgcgctacatccccccaatcccagtccacagggacttcggctttggctgggctctcgtcagcgacatcctcctctgccttcccctctccatcttcatccagattgtgcaagtcagctacaaggtggacaacctggaggaatttctgaacgacccgctgaagaagcacacgctgatccgctttctccccaggcccattcggcagcagcttctgtacaagaggcgttacattttttcggtggtggagaaccttcagaggctgtgctacatgggggtgctacagtttggtcccacggaaaagtttcaggataaagatcaggtctttatcttcttgaagaagaatgcagtcattgttgacactaccatctgcgacccacattacaacctgggccgcaggaggcggcccttcgagaggcgcctctatgtcctgaactcaatgcaggatgtggaaaactactggtttgacctgcagtgcgtctgcctcaacaccccactaggcgtggtgcgctgcccgcgcgtcaggaagaacagcagcacagaccagggcagcgacgaggagggcagcctgcagaaggagcaggagagcgccatggacaagcacaacctggagcgcaagtgcgccatgctggagtacaccactggaagccgtgaggtggtggatgaaggcttgatccctggagatgggctgggtgccgcagggctcgattccagcttctacggacacctcaagcgcaactggatctggaccagctacatcatcaaccaggccaaaaaggagaacactgccgcagagaatggactcacagtgaggctccagacatttctgtccaagcgcccaatgcccctcagtgccagaggcaacagcaggttgaatatttggggggaagcaagagtaggctccgagctctgtgctggctgggaagagcagtttgaggtggaccgagagccctcgctggaccgaaaccggagagtgaggggtgggaaaagccagaagcggaagcggctgaagaaggaccctgggaagaagatcaagagaaagaagaaaggagagttcccaggagaaaaaagcaaaaggctgcgctaccatgatgaagccgaccagagtgccctgcatcggatgacgcggcttcgtgtcacctggtctatgcaggaggatgggctgcttgtgctgtgccgcattgccagcaatgtcctcaacaccaaggtgaagggtccatttgtcacctggcaggtggtacgggacattttgcatgccacgtttgaagagtctttggataaaacatctcattcccttggacgaagagctcgctacatagtcaaaaacccacaggcctatctcaactataaagtgtgcctggccgaggtgtaccaggataaagcacttgttggagatttcatgaatcgaagaggtgactatgatgacccaaaggtttgtgccaacgagtttaaagaatttgtggagaagcttaaagaaaagttcagttcagccctaaggaattctaaccttgaaatcccagacacactccaggagctgttcgccaggtaccgagttttggcaattggggatgaaaaagatcaaaccaggaaagaggatgaacttaacagcgtggatgacatccactttctggtgcttcagaacctgatccagagcacgctggccctctcagacagtcagatgaagtcctaccagtcattccagactttccgcctctatcgggagtacaaggaccacgttcttgtgaaggccttcatggagtgccagaagaggagcttggtcaaccggcgccgggtcaaccacacgctgggccccaagaagaaccgggccctccccttcgtgccaatgtcctaccagctatcccagacctactacaggatttttacgtggcgatttccaagcaccatctgcacggagtcattccagtttttggacagaatgcgggctgccggcaagttggaccagcctgatcgtttctctttcaaagaccaggataataacgagcccacaaacgacatggtggccttttcactggacggccctggaggaaattgtgtggccgtcctgaccctcttctctctgggcctcatttctgtggatgtcaggatcccggagcagatcatcgtggtagacagctcaatggtggagaatgaggtcatcaaaagcttggggaaggacggcagcctggaggatgacgaggatgaagaggatgacttggacgaaggtgtagggggcaagcgccggagcatggaggtgaaacctgcgcaagcctcccacaccaactacctgctgatgaggggctactactcccccggcatcgtcagcacccgcaacctcaaccccaacgacagcattgtggtcaactcctgccagatgaagttccagctccgctgcacccctgtgcccgcccggctcaggcccgctgccgctcctctggaagagctaacaatgggaacctcctgcctccctgatacgttcaccaagctgataaacccccaggaaaacacctgcagcttggaggagtttgtcctccagctggagctgtctgggtatagtcccgaagacctgactgctgccttggagatcttggaagccattatagccacgggttgttttgggattgacaaggaggagctgcgcagacggttctcggccttggagaaggcaggtggtgggcgcaccaggacattcgcagattgcatccaggccctcctggagcagcatcaggtgctggaggtcggtggcaacactgcgcgcctggtagccatgggctctgcctggccttggctcctgcactccgtgcggctgaaagacagagaagacgccgacatccagagagaagacccccaggccagacccctggaggggtcttccagtgaggacagcccccccgaggggcaggcacctccttctcacagcccccggggcaccaagaggcgcgccagctgggccagtgagaatggggagaccgacgccgagggcacccagatgacccctgccaagaggccagcgctccaggactcaaatttggcccccagccttgggcccggagctgaagatggggcagaagcccaggccccatctccacccccagctcttgaagacaccgctgcagcgggagcagcacaggaagaccaagagggtgtcgggttcacagagagtttcggagctgccaacatctcccaggcagcacgggaaagggactgtgagagtgtctgcttcatcggccggccgtggcgtgtcgtggatggccacctgaaccttcctgtatgcaagggtatgatggaggccatgctgtaccacatcatgaccaggcctggcatccccgagagctccctgctgcgccactaccagggggtcctgcagcccgtcgccgtgctggagttgctccagggcctggagtccctcggctgcatccggaagcgctggctgagaaagccaaggcctgtctcgctcttctctacacccgtggtggaagaggtggaagtgccctccagcctggacgagagccccatggctttctatgagcccaccttggactgtaccctccggctgggccgtgtgttcccccacgaggtcaactggaacaagtggatccacctctaggacccctgtgggcgtcccctccctcccagccaccgcctgccacaccactcctgcctggtgctcggcagaccccactgtgccctggccttgggtctgccgagcctcctgcagcaggggacgggtgctttggccagagtcacagactgacacgtttcccactgtactggaactctggaaagaggggctccccgacctgcccatcccccaggctcttctgggccttccccttgggaactggcctcatcacactgggagttggtgcttcttgtctctgggtctccagagtttgccccgcctgtgcacacctcacattccagactctagccatctcggcaggatctcctggctccttgagtgcccaggtgccaccaagaggaagggccttgtgggatacaccttgcagaatagggatcggtgtgccccgctgcgaggggccccccatgggggctgtggcccctccgcaggcaggacatcccaacccctggctgggactgaaccacccagagcggagcggctcccttttcagccttgtgagtcacctggcaggccccagctgggctggctgtccgtgtccctcagcctggctggtgattccttgcaggaggg

SEQ ID NO: 73 - protein, 2084 aa, Homo sapiens
MDALESLLDEVALEGLDGLCLPALWSRLETRVPPFPLPLEPCTQEFLWRALATHPGISFYEEPRERPDLQLQDRYEEIDLETGILESRRDPVALEDVYPIHMILENKDGIQGSCRYFKERKNITNDIRTKSLQPRCTMVEPFDRWGKKLIIGSLPAHAVQALDSPGGGSRPEAARLLLLHPGTARPVQVQGELQRDLHTTAFKVDAGKLHYHRKILNKNGLITMQSHVIRLPTGAQQHSILLLLNRFHVDRRSKYDILMEKLSVMLSTRTNHIETLGKLREELGLCERTFKRLYQYMLNAGLAKVVSLRLQEIHPECGPCKTKKGTDVMVRCLKLLKEFKRNDHDDDEDEEVISKTVPPVDIVFERDMLTQTYDLIERRGTKGISQAEIRVAMNVGKLEARMLCRLLQRFKVVKGFMEDEGRQRTTKYISCVFAEESDLSRQYQREKARSELLTTVSLASMQEESLLPEGEDTFLSESDSEEERSSSKRRGRGSQKDTRASANLRPKTQPHHSTPTKGGWKVVNLHPLKKQPPSFPGAAEERACQSLASRDSLLDTSSVSEPNVSFVSHCADSNSGDIAVIEEVRMENPKESSSSLKTGRHSSGQDKPHETYRLLKRRNLIIEAVTNLRLIESLFTIQKMIMDQEKQEGVSTKCCKKSIVRLVRNLSEEGLLRLYRTTVIQDGIKKKVDLVVHPSMDQNDPLVRSAIEQVRFRISNSSTANRVKTSQPPVPQGEAEEDSQGKEGPSGSGDSQLSASSRSESGRMKKSDNKMGITPLRNYHPIVVPGLGRSLGFLPKMPRLRVVHMFLWYLIYGHPASNTVEKPSFISERRTIKQESGRAGVRPSSSGSAWEACSEAPSKGSQDGVTWEAEVELATETVYVDDASWMRYIPPIPVHRDFGFGWALVSDILLCLPLSIFIQIVQVSYKVDNLEEFLNDPLKKHTLIRFLPRPIRQQLLYKRRYIFSVVENLQRLCYMGVLQFGPTEKFQDKDQVFIFLKKNAVIVDTTICDPHYNLGRRRRPFERRLYVLNSMQDVENYWFDLQCVCLNTPLGVVRCPRVRKNSSTDQGSDEEGSLQKEQESAMDKHNLERKCAMLEYTTGSREVVDEGLIPGDGLGAAGLDSSFYGHLKRNWIWTSYIINQAKKENTAAENGLTVRLQTFLSKRPMPLSARGNSRLNIWGEARVGSELCAGWEEQFEVDREPSLDRNRRVRGGKSQKRKRLKKDPGKKIKRKKKGEFPGEKSKRLRYHDEADQSALHRMTRLRVTWSMQEDGLLVLCRIASNVLNTKVKGPFVTWQVVRDILHATFEESLDKTSHSLGRRARYIVKNPQAYLNYKVCLAEVYQDKALVGDFMNRRGDYDDPKVCANEFKEFVEKLKEKFSSALRNSNLEIPDTLQELFARYRVLAIGDEKDQTRKEDELNSVDDIHFLVLQNLIQSTLALSDSQMKSYQSFQTFRLYREYKDHVLVKAFMECQKRSLVNRRRVNHTLGPKKNRALPFVPMSYQLSQTYYRIFTWRFPSTICTESFQFLDRMRAAGKLDQPDRFSFKDQDNNEPTNDMVAFSLDGPGGNCVAVLTLFSLGLISVDVRIPEQIIVVDSSMVENEVIKSLGKDGSLEDDEDEEDDLDEGVGGKRRSMEVKPAQASHTNYLLMRGYYSPGIVSTRNLNPNDSIVVNSCQMKFQLRCTPVPARLRPAAAPLEELTMGTSCLPDTFTKLINPQENTCSLEEFVLQLELSGYSPEDLTAALEILEAIIATGCFGIDKEELRRRFSALEKAGGGRTRTFADCIQALLEQHQVLEVGGNTARLVAMGSAWPWLLHSVRLKDREDADIQREDPQARPLEGSSSEDSPPEGQAPPSHSPRGTKRRASWASENGETDAEGTQMTPAKRPALQDSNLAPSLGPGAEDGAEAQAPSPPPALEDTAAAGAAQEDQEGVGFTESFGAANISQAARERDCESVCFIGRPWRVVDGHLNLPVCKGMMEAMLYHIMTRPGIPESSLLRHYQGVLQPVAVLELLQGLESLGCIRKRWLRKPRPVSLFSTPVVEEVEVPSSLDESPMAFYEPTLDCTLRLGRVFPHEVNWNKWIHL

SEQ ID NO: 74 - DNA, 473 bp, Homo sapiens
atcctcaggccatggccaacactgagagcatcattatcaatccgagtgctgttcagcacagcctggtgggtgaaatcatcaaatactctgagcagaagggattctacctggtgaccatgaagttccttcgggcctctgagaaacccctgaaggagcactacactaacctgaaagaccacccattcttcccggaccttgtgaagtacatgaactcagggcaggttgtggccatggtcctggaggggctgaatgtggcaaagacagggctaaggatgcttggggagaccaattcattgggctctatgctagagactattattcgcagggacttctgcgctaaaataggcgggaacgtcattggtggcagtgattcattacaaagtgctggcaaagaaatggctaaatggcttaaagaagaagaactggttgactacaaatctcgtgcctatgacaagatctatgataaaaaggag

SEQ ID NO: 75 - protein, 181 aa, Homo sapiens [sequence omitted]

SEQ ID NO: 76 - DNA, 1326 bp, Homo sapiens
  CDS (121)..(1323)
tgggggcggctactgctcatgtgattgtggagtagacagttggaagaagtacccagtccatttggagagttaaaactgtgcctaacagaggtgtcctctgacttttcttctgcaagctccatgttttcacatcttccctttgactgtgtcctgctgctgctgctactacttacaaccctgttctcccgtgttcacagaattgggccacaattctctcctagggcagtgtttctgaaagtgagcagacaaaatggggtagggaaacaatcagataacgcatttgtgtctggccagggtgaccgcaccggtaaagatgagctatcaatctgcattgcacagctgaccaggaatttccttgtgggcaaaatatgggggagtagcttcctctttattctgttagacatggcttgcagttttcctgaaatggagttacctcactcaccgcttgagtcttggctctccttctctctctatgcagggtcctcagaagtggaatacagagcggaggtcggtcagaatgcctatctgccctgcttctacaccccagccgccccagggaacctcgtgcccgtctgctggggcaaaggagcctgtcctgtgtttgaatgtggcaacgtggtgctcaggactgatgaaagggatgtgaattattggacatccagatactggctaaatggggatttccgcaaaggagatgtgtccctgaccatagagaatgtgactctagcagacagtgggatctactgctgccggatccaaatcccaggcataatgaatgatgaaaaatttaacctgaagttggtcatcaaaccagccaaggtcacccctgcaccgactcggcagagagacttcactgcagcctttccaaggatgcttaccaccaggggacatggcccacatgatggtggttcttgtctttcacttccagatgtaagactcacccaaatatccacattggccaatgagttacgggactctagattggccaatgacttacgggactctggagcaaccatcagaataggcatctacatcggagcagggatctgtgctgggctggctctggctcttatcttcggcgctttaattttcaaatgttattctcatagcaaagagaagatacagaatttaagcctcatctctttggccaacctccctccctcaggattggcaaatgcagtagcagagggaattcgctcagaagaaaacatctataccattgaagagaacgtatatgaagtggaggagcccaatgagtattattgctatgtcagcagcaggcagcaaccctcacaacctttgggttgtcgctttgcaatgccatag

SEQ ID NO: 77 - protein, 401 aa, Homo sapiens [sequence omitted]

SEQ ID NO: 78 - DNA, 1741 bp, Homo sapiens
  CDS (5)..(1723)
gcctatggccatggccttcacagacctgctggatgctctgggcagcatgggccgcttccagctcaaccacacagccctgctgctgctgccctgcggcctgctggcctgccacaacttcctgcagaacttcaccgccgctgtccccccccaccactgccggggccctgccaaccacactgaggcctccaccaacgactcgggggcctggctgagggccaccatacccctggaccagcttggggcccctgagccctgccggcgcttcaccaagcctcagtgggccctgctgagccccaactcctccatcccgggcgcggccacggagggctgcaaggacggctgggtctataaccgcagtgttttcccgtccaccatcgtgatggaggtcagaaggggctgggtgtgtgggggggctgctgccgaggcccagtctgaagcgcccatgtcttccctgcagtgggatctggtgtgtgaggcccgcactctccgagacctggcgcagtccgtctacattgccggggtgctggtgggggctgccgtgtttggcagcttggcagacaggctgggctgcaagggccccctggtctggtcctacctgcagctggcagcttcgggggccgccacagcgtatttcagctccttcagtgcctattgcgtcttccggttcctgatgggcatgaccttctctggcatcgtggagtggatgcccacacggggccggactgtggcgggtattttgctggggtattccttcaccctgggccagctcatcctggctggggtagcctacctgattcgcccctggcggtgcctgcagtttgccatctctgctcctttcctgatctttttcctctattcttggtggcttccagagtcatcccgctggctcctcctgcatggcaagtcccagttagctgtacagaatctgcagaaggtggctgcaatgaacgggaggaagcaggaaggggaaaggctgaccaaggaggtgatgagctcctacatccaaagcgagtttgcaagtgtctgcacctccaactcaatcttggacctcttccgaaccccggccatccgcaaggtcacatgctgtctcatggtgatttggttctccaactctgtggcttactatggcctggccatggacctgcagaagtttgggctcagcctatacctggtgcaggccctgtttggaatcatcaacatcccggccatgctggtggccaccgccaccatgatttacgtgggccgccgtgccacggtggcctccttcctcatcctggccgggctcatggtgatcgccaacatgtttgtgccagaaggtacgcagatcctgtgcacagcccaggcagcgctgggcaaaggctgcctggccagctccttcatctgtgtgtacctgtttaccggcgagctgtaccccacggagatcaggcagatggggatgggctttgcctctgtccacgcccgcctcgggggcctgacggcgcccctggttaccacacttggggaatacagcaccatcctgccacccgtgagctttggggccaccgcaatcctggctgggctggccgtctgcttcctgactgagacccgcaacatgcccctggtggagaccatcgcagccatggagaggagggtcaaagaaggctcttccaagaaacatgtagaagagaagagtgaagaaatttctcttcagcagctgagagcatctcccctcaaagagaccatctaagctgcctggaacctg

SEQ ID NO: 79 - protein, 573 aa, Homo sapiens
MAMAFTDLLDALGSMGRFQLNHTALLLLPCGLLACHNFLQNFTAAVPPHHCRGPANHTEASTNDSGAWLRATIPLDQLGAPEPCRRFTKPQWALLSPNSSIPGAATEGCKDGWVYNRSVFPSTIVMEVRRGWVCGGAAAEAQSEAPMSSLQWDLVCEARTLRDLAQSVYIAGVLVGAAVFGSLADRLGCKGPLVWSYLQLAASGAATAYFSSFSAYCVFRFLMGMTFSGIVEWMPTRGRTVAGILLGYSFTLGQLILAGVAYLIRPWRCLQFAISAPFLIFFLYSWWLPESSRWLLLHGKSQLAVQNLQKVAAMNGRKQEGERLTKEVMSSYIQSEFASVCTSNSILDLFRTPAIRKVTCCLMVIWFSNSVAYYGLAMDLQKFGLSLYLVQALFGIINIPAMLVATATMIYVGRRATVASFLILAGLMVIANMFVPEGTQILCTAQAALGKGCLASSFICVYLFTGELYPTEIRQMGMGFASVHARLGGLTAPLVTTLGEYSTILPPVSFGATAILAGLAVCFLTETRNMPLVETIAAMERRVKEGSSKKHVEEKSEEISLQQLRASPLKETI

SEQ ID NO: 80 - DNA, 1690 bp, Homo sapiens
  CDS (5)..(1672)
gcctatggccatggccttcacagacctgctcatggccttcacagacctgctggatgctctgggcagcatgggccgcttccagctcaaccacacagccctgctgctgctgccctgcggcctgctggcctgccacaacttcctgcagaacttcacggccgctgtccccccccaccactgccggggccctgccaaccacactgaggactccaccaacgactcgggggcctggctgagggccaccatacccctggaccagcttggggcccctaagccctgccggcgcttcaccaagcctcagtgggccctgctgagccccaactcctccatcccgggcgcggccacggagggctgcaaggacggctgggtctataaccgcagtgttttcccgtccaccatcgtgatggagtgggatctggtgtgtgaggcccgcactctccgagacctggtgcagtccgtctacatggccggggtgctggtgggggctgccgtgtttggcagcttggcagacaggctgggctgcaagggccccctggtctggtcctacctgcagctggcagcttcgggggccgccacagcgtatttcagctccttcagtgcctattgcgtcttccggttcctgatgggcatgaccttctctggcatcgtggagtggatgcccacacggggccggactgtggcgggtattttgctggggtattccttcaccctgggccagctcatcctggctggggtagcctacctgattcgcccctggcggtgcctgcagtttgccatctctgctcctttcctgatctttttcctctattcttggtggcttccagagtcatcccgctggctcctcctgcatggcaagtcccagttagctgtacagaatctgcagaaggtggctgcaatgaacgggaggaagcaggaaggggaaaggctgaccaaggaggtgatgagctcctacatccaaagcgagtttgcaagtgtctgcacctccaactcaatcttggacctcttccgaaccccggccatccgcaaggtcacatgctgtctcatggtgatttggttctccaactctgtggcttactatggcctggccatggacctgcagaagtttgggctcagcctatacctggtgcaggccctgtttggaatcatcaacatcccggccatgctggtggccaccgccaccatgatttacgtgggccgccgtgccacggtggcctccttcctcatcctggccgggctcatggtgatcgccaacatgtttgtgccagaaggtacgcagatcctgtgcacagcccaggcagcgctgggcaaaggctgcctggccagctccttcatctgtgtgtacctgtttaccggcgagctgtaccccacggagatcaggcagatggggatgggctttgcctctgtccacgcccgcctcgggggcctgacggcgcccctggttaccacacttggggaatacagcaccatcctgccacccgtgagctttggggccaccgcaatcctggctgggctggccgtctgcttcctgactgagacccgcaacatgcccctggtggagaccatcgcagccatggagaggagggtcaaagaaggctcttccaagaaacatgtagaagagaagagtgaagaaatttctcttcagcagctgagagcatctcccctcaaagagaccatctaagctgcctggaacctg

SEQ ID NO: 81 - protein, 556 aa, Homo sapiens
MAMAFTDLLMAFTDLLDALGSMGRFQLNHTALLLLPCGLLACHNFLQNFTAAVPPHHCRGPANHTEDSTNDSGAWLRATIPLDQLGAPKPCRRFTKPQWALLSPNSSIPGAATEGCKDGWVYNRSVFPSTIVMEWDLVCEARTLRDLVQSVYMAGVLVGAAVFGSLADRLGCKGPLVWSYLQLAASGAATAYFSSFSAYCVFRFLMGMTFSGIVEWMPTRGRTVAGILLGYSFTLGQLILAGVAYLIRPWRCLQFAISAPFLIFFLYSWWLPESSRWLLLHGKSQLAVQNLQKVAAMNGRKQEGERLTKEVMSSYIQSEFASVCTSNSILDLFRTPAIRKVTCCLMVIWFSNSVAYYGLAMDLQKFGLSLYLVQALFGIINIPAMLVATATMIYVGRRATVASFLILAGLMVIANMFVPEGTQILCTAQAALGKGCLASSFICVYLFTGELYPTEIRQMGMGFASVHARLGGLTAPLVTTLGEYSTILPPVSFGATAILAGLAVCFLTETRNMPLVETIAAMERRVKEGSSKKHVEEKSEEISLQQLRASPLKETI

SEQ ID NO: 82 - DNA, 1082 bp, Homo sapiens
  CDS (16)..(927)
ctgagtggagccaccatggcccgggggctcgctgtcctgctagtcttgttcctgcatatcaagaacctgcctgcccaggctgcggacacatgtccagaggtgaaggtggtgggcctggagggctctgacaagctcaccattctccgaggctgcccggggctgcccggggccccagggccaaagggagaggcaggtgtcattggagagagaggagaacgcggtctccctggagcccctggaaaggcaggaccagtggggcccaaaggagaccgaggagagaaggggatgcgtggagagaaaggagacgctgggcagtctcagtcgtgtgcgacaggcccacgcaactgcaaggacctgctagaccgggggtatttcctgagcggctggcacaccatctacctgcccgactgccggcccctgactgtgctctgtgacatggacacggacggagggggctggaccgttttccagcggaggatggatggctctgtggacttctatcgggactgggccgcatacaagcagggcttcggcagtcagctgggggagttctggctggggaacgacaacatccacgccctgactgcccagggaagcagcgagctccgtgtagacctggtggactttgagggcaaccaccagtttgctaagtacaaatcattcaaggtggctgacgaggcagagaagtacaagctggtactgggagcctttgtcgggggcagtgcggaccaagacaatgatgtgagttcttcgaattgtgctgagaagttccagggagcctggtggtacgccgactgtcatgcttcaaacctcaatggtctctacctcatgggaccccatgagagccatgccaatggtatcaactggagtgcggcgaaggggtacaaatatagctacaaggtgtcagagatgaaggtgcggcccgcctagacgggccaggacccctccacatgcacctgctagtggggaggccacacccacaagcgctgcgtcgtggaagtcaccccatttccccagccagacacactcccatgacgcccacagctgcccctttgcccccagctcagtcaagccgccacatg

SEQ ID NO: 83 - protein, 304 aa, Homo sapiens
MARGLAVLLVLFLHIKNLPAQAADTCPEVKVVGLEGSDKLTILRGCPGLPGAPGPKGEAGVIGERGERGLPGAPGKAGPVGPKGDRGEKGMRGEKGDAGQSQSCATGPRNCKDLLDRGYFLSGWHTIYLPDCRPLTVLCDMDTDGGGWTVFQRRMDGSVDFYRDWAAYKQGFGSQLGEFWLGNDNIHALTAQGSSELRVDLVDFEGNHQFAKYKSFKVADEAEKYKLVLGAFVGGSADQDNDVSSSNCAEKFQGAWWYADCHASNLNGLYLMGPHESHANGINWSAAKGYKYSYKVSEMKVRPA

SEQ ID NO: 84 - DNA, 1332 bp, Homo sapiens
  CDS (183)..(1106)
ttttaggtctgtttgtcgtaggcagatggagcttgttataattatgcctcatagggatagtacaaggaaggggtaggctatgtgttttgtcagggagttgagaaactgtggcacaaggcgagagctggtttcctctgccctgttagagctgggggactcttcagagtcaaaggccagagagcatggagctgagtggagccaccatggcccgggggctcgctgtcctgctagtcttgttcctgcatatcaagaacctgcctgcccaggctgcggacacatgtccagaggtgaaggtggtgggcctggagggctctggcaagctcaccattctccgaggctgcccggggctgcccggggccccagggccaaagggagaggcaggtgtcattggagagagaggagaccgaggagagaaggggatgcgtggagagaaaggagacgctgggcagtctcagtcgtgtgcgacaggcccacgcaactgcaaggacctgctagaccgggggtatttcctgagcggctggcacaccatctacctgcccgactgccggcccctgactgtgctctgtgacatggacacggacggagggggctggaccgttttccagcggaggatggatggctctgtggacttctatcgggactgggccgcatacaagcagggcttcggcagtcagctgggggagttctggctggggaatgacaacatccacgccctgactgcccagggaagcagcgagctccgtgtagacctggtggactttgagggcaaccaccagtttgctaagtacaaatcattcaaggtggctgacgaggcagagaagtacaagctggtactgggagcctttgtcgggggcagtgcgggtaattctctaacgggccacaacaacaacttcttctccaccaaagaccaagacaatgatgtgagttcttcgaattgtgctgagaagttccaaggagcctggtggtacgccgactgtcatgcttcaaacctcaatggtctctacctcatgggaccccatgagagctatgccaatggtatcaactggagtgcggcgaaggggtacaaatatagctacaaggtgtcagagatgaaggtgcggcccgcctagacgggccaggacccctccacatgcacctgctagtggggaggccacacccacaagcgctgcgtcgtggaagtcaccccatttccccagccagacacactcccatgacgcccacagctgcccctttgcccccagctcagtcaagccgccacatgcccacaacctcaccagagggagaattatgtttctaaatatgtttacttttggggacagaaaaaaaaaaaaa

SEQ ID NO: 85 - protein, 308 aa, Homo sapiens
MELSGATMARGLAVLLVLFLHIKNLPAQAADTCPEVKVVGLEGSGKLTILRGCPGLPGAPGPKGEAGVIGERGDRGEKGMRGEKGDAGQSQSCATGPRNCKDLLDRGYFLSGWHTIYLPDCRPLTVLCDMDTDGGGWTVFQRRMDGSVDFYRDWAAYKQGFGSQLGEFWLGNDNIHALTAQGSSELRVDLVDFEGNHQFAKYKSFKVADEAEKYKLVLGAFVGGSAGNSLTGHNNNFFSTKDQDNDVSSSNCAEKFQGAWWYADCHASNLNGLYLMGPHESYANGINWSAAKGYKYSYKVSEMKVRPA

SEQ ID NO: 86 - DNA, 728 bp, Homo sapiens
  CDS (1)..(573)
ctgcatatcaagaacctgcctgcccaggctgcggacacatgtccagaggtgaaggtggtgggcctggagggctctgacaagctcaccattctccgaggctgcccggggctgcccggggccccagggccaaagggagaggcaggtgtcattggagagagaggagaacgcggtctccctggagcccctggaaaggcaggaccagtggggcccaaaggagaccgaggagagaaggggatgcgtggagagaaaggagacgctgggcagtctcagtcgtgtgcgacaggcccacgcaactgcaaggacctgctagaccgggggtatttcctgagcggctggcacaccatctacctgcccgactgccggcccctgactgtgctctgtgacatggacacggacggagggggctggaccgttttccagggagcctggtggtacgccgactgtcatgcttcaaacctcaatggtctctacctcatgggaccccatgagagctatgccaatggtatcaactggagtgcggcgaaggggtacaaatatagctacaaggtgtcagagatgaaggtgcggcccgcctagacgggccaggacccctccacatgcacctgctagtggggaggccacacccacaagcgctgcgtcgtggaagtcaccccatttccccagccagacacactcccatgacgcccacagctgcccctttgcccccagctcagtcaagccgccacatg

SEQ ID NO: 87 - protein, 191 aa, Homo sapiens
LHIKNLPAQAADTCPEVKVVGLEGSDKLTILRGCPGLPGAPGPKGEAGVIGERGERGLPGAPGKAGPVGPKGDRGEKGMRGEKGDAGQSQSCATGPRNCKDLLDRGYFLSGWHTIYLPDCRPLTVLCDMDTDGGGWTVFQGAWWYADCHASNLNGLYLMGPHESYANGINWSAAKGYKYSYKVSEMKVRPA

SEQ ID NO: 88 - DNA, 1104 bp, Homo sapiens
  CDS (16)..(882)
ctgagtggagccaccatggcccgggggctcgctgtcctgctagtcttgttcctgcatatcacgaacctgcctgcccaggctgcggacacatgtccagaggtgaaggtggtgggcctggagggctctgacaagctcaccattctccgaggctgcccggggctgcccggggccccaggaccaaagggagaggcaggtgtcattggagagaaaggagacgctgggcagtctcagtcgtgtgcgacaggcccacgcaactgcaaggacctgctagaccgagggtatttcctgagcggctggcacaccatctacctgcccgactgccggccccttactgtgctctgtgacatggatacggacggagggggctggaccgttttccagcggaggatggatggctctgtggacttctatcgggactgggccgcatacaagcagggcttcggcagtcagctgggggagttctggctggggaatgacaacatccacgccctgactgcccagggaagcagcgagctccgtgtagacctggtggactttgagggcaaccaccagtttgctaagtacaaatcattcaaggtggctgacgaggcagagaagtacaagctggtactgggagcctttgtcgggggcagtgcgggtaattctctaacgggccacaacaacaacttcttctccaccaaagaccaagacaatgatgtgagttcttcgaattgtgctgagaagttccagggagcctggtggtacgccgactgtcatgcttcaaacctcaatggtctctacctcatgggaccccatgagagctatgccaatggtatcaactggagtgcggcgaaggggtacaaatatagctacaaggtgtcagagatgaaggtgcggcccgcctagacgggccaggacccctccacatgcacctgctagtggggaggccacacccacaagcgctgcgtcgtggaagtcaccccatttccccagccagacacactcccatgacgcccacagctgcccctttgcccccagctcagtcaagccgccacatgcccacaacctcaccagagggagaattatgtttctaaatatgtttactttgggacagaaaaaaaaaaa

SEQ ID NO: 89 - protein, 289 aa, Homo sapiens
MARGLAVLLVLFLHITNLPAQAADTCPEVKVVGLEGSDKLTILRGCPGLPGAPGPKGEAGVIGEKGDAGQSQSCATGPRNCKDLLDRGYFLSGWHTIYLPDCRPLTVLCDMDTDGGGWTVFQRRMDGSVDFYRDWAAYKQGFGSQLGEFWLGNDNIHALTAQGSSELRVDLVDFEGNHQFAKYKSFKVADEAEKYKLVLGAFVGGSAGNSLTGHNNNFFSTKDQDNDVSSSNCAEKFQGAWWYADCHASNLNGLYLMGPHESYANGINWSAAKGYKYSYKVSEMKVRPA

SEQ ID NO: 90 - DNA, 988 bp, Homo sapiens
  CDS (56)..(904)
gtttcctctgccctgttagagctgggggactcttcagagtcaaaggccagagagcatggagctgagtggagccaccatggcccgggggctcgctgtcctgctagtcttgttcctgcatatcaagaacctgcctgcccaggctgcggacacatgtccagaggtgaaggtggtgggcctggagggctctgacaagctcaccattctccgaggctgcccggggctgcccggggccccagggccaaagggagaggcaggtgtcattggagagagaggagaacgcggtctccctggagcccctggaaaggcaggaccagtggggcccaaaggagaccgaggagagaaggggatgcgtggagagaaaggagacgctgggcagtctcagtcgtgtgcgacaggtccacgcaactgcaaggacctgctagaccgggggtatttcctgagcggctggcacaccatctacctgcccgactgccggcccctgactgtgctctgtgacatggacacggacggagggggctggaccgttttccagcggaggatggatggctctgtggactttgagggcaaccaccagtttgctaagtacaaatcattcaaggtggctgacgaggcagagaagtacaagctggtactgggagcctttgtcgggggcagtgcgggtaattctctaacgggccacaacaacaacttcttctccaccaaagaccaagacaatgatgtgagttcttcgaattgtgctgagaagttccaaggagcctggtggtacgccgactgtcatgcttcaaacctcaatggtctctacctcatgggaccccatgagagctatgccaatggtatcaactgcagtgcggcgaaggggtacaaatatagctacaaggtgtcagagatgaaggtgcggcccgcctagacgggccaggacccctccacatgcacctgctagtggggaggccacacccacaagcgctgcgtcgtggaagtcacccatttc

SEQ ID NO: 91 - protein, 283 aa, Homo sapiens
MELSGATMARGLAVLLVLFLHIKNLPAQAADTCPEVKVVGLEGSDKLTILRGCPGLPGAPGPKGEAGVIGERGERGLPGAPGKAGPVGPKGDRGEKGMRGEKGDAGQSQSCATGPRNCKDLLDRGYFLSGWHTIYLPDCRPLTVLCDMDTDGGGWTVFQRRMDGSVDFEGNHQFAKYKSFKVADEAEKYKLVLGAFVGGSAGNSLTGHNNNFFSTKDQDNDVSSSNCAEKFQGAWWYADCHASNLNGLYLMGPHESYANGINCSAAKGYKYSYKVSEMKVRPA

SEQ ID NO: 92 - DNA, 1194 bp, Homo sapiens
  CDS (16)..(972)
ctgagtggagccaccatggcccgggggctcgctgtcctgctagtcttgttcctgcatatcaagaacctgcctgcccaggctgcggacacatgtccagaggtgaaggtggtgggcctggagggctctgacaagctcaccattctccgaggctgcccggggctgcccggggccccagggccaaagggagaggcaggtgtcattggagagagaggagaacgcggtctccctggagcccctggaaaggcaggaccagtggggcccaaaggagaccgaggagagaaggggatgcgtggagagaaaggagacgctgggcagtctcagtcgtgtgcgacaggcccacgcaactgcaaggacctgctagaccgggggtatttcctgagcggctggcacaccatctacctgcccgactgccggcccctgactgtgctctgtgacatggacacggacggagggggctggaccgttttccagcggaggatggatggctctgtggacttctatcgggactgggccgcatacaagcagggcttcggcagtcagctgggggagttctggctggggaacgacaacatccacgccctgactgcccagggaagcagcgagctccgtgtagacctggtggactttgagggcaaccaccagtttgctaagtacaaatcattcaaggtggctgacgaggcagagaagtacaagctggtactgggagcctttgtcgggggcagtgcgggtaattctctaacgggccacaacaacaacttcttctccaccaaagaccaagacaatgatgtgagttcttcgaattgtgctgagaagttccagggagcctggtggtacgccgactgtcatgcttcaaacctcaatggtctctacctcatgggaccccatgagagctatgccaatggtatcaactggagtgcggcgaaggggtacaaatatagctacaaggtgtcagagatgaaggtgcggcccgcctagacgggccaggacccctccacatgcacctgctagtggggaggccacacccacaagcgctgcgtcgtggaagtcaccccatttccccagccagacacactcccatgacgcccacagctgcccctttgcccccagctcagtcaagccgccacatgcccacaacctcaccagagggagaattatgtttctaaatatgtttactttgggacagaaaaaaaaaaa

SEQ ID NO: 93 - protein, 319 aa, Homo sapiens
MARGLAVLLVLFLHIKNLPAQAADTCPEVKVVGLEGSDKLTILRGCPGLPGAPGPKGEAGVIGERGERGLPGAPGKAGPVGPKGDRGEKGMRGEKGDAGQSQSCATGPRNCKDLLDRGYFLSGWHTIYLPDCRPLTVLCDMDTDGGGWTVFQRRMDGSVDFYRDWAAYKQGFGSQLGEFWLGNDNIHALTAQGSSELRVDLVDFEGNHQFAKYKSFKVADEAEKYKLVLGAFVGGSAGNSLTGHNNNFFSTKDQDNDVSSSNCAEKFQGAWWYADCHASNLNGLYLMGPHESYANGINWSAAKGYKYSYKVSEMKVRPA

SEQ ID NO: 94 - DNA, 1144 bp, Homo sapiens
  CDS (183)..(980)
ttttaggtctgtttgtcgtaggcagatggagcttgttataattatgcctcatagggatagtacaaggaaggggtaggctatgtgttttgtcagggagttgagaaactgtggcacaaggcgagagctggtttcctctgccctgttagagctgggggactcttcagagtcaaaggccagagagcatggagctgagtggagccaccatggcccgggggctcgctgtcctgctagtcttgttcctgcatatcaagaacctgcctgcccaggctgcggacacatgtccagaggtgaaggtggtgggcctggagggctctgacaagctcaccattctccgaggctgcccggggctgcccggggccccagggccaaagggagaggcaggtgtcattggagagagaggagaacgcggtctccctggagcccctggaaaggcaggaccagtggggcccaaaggagaccgaggagagaaggggatgcgtggagagaaaggagacgctgggcagtctcagtcgtgtgcgacaggcccacgcaactgcaaggacctgctagaccgggggtatttcctgagcggctggcacaccatctacctgcccgactgccggcccctgactgtgctctgtgacatggacacggacggagggggctggaccgttttccagcggaggatggatggctctgtggacttctatcgggactgggccgcatacaagcagggcttcggcagtcagctggggggtaattctctaacgggccacaacaacaacttcttctccaccaaagaccaagacaatgatgtgagttcttcgaattgtgctgagaagttccaaggagcctggtggtacgccgactgtcatgcttcaaacctcaatggtctctacctcatgggaccccatgagagctatgccaatggtatcaactggagtgcggcgaaggggtacaaatatagctacaaggtgtcagagatgaaggtgcggcccgcctagacgggccaggacccctccacatgcacctgctagtggggaggccacacccacaagcgctgcgtcgtggaagtcaccccatttccccagccagacacactcccatgacgcccacagctgcccctttgcccccagctcagtcaagccgccacatgcccacaacc

SEQ ID NO: 95 - protein, 266 aa, Homo sapiens
MELSGATMARGLAVLLVLFLHIKNLPAQAADTCPEVKVVGLEGSDKLTILRGCPGLPGAPGPKGEAGVIGERGERGLPGAPGKAGPVGPKGDRGEKGMRGEKGDAGQSQSCATGPRNCKDLLDRGYFLSGWHTIYLPDCRPLTVLCDMDTDGGGWTVFQRRMDGSVDFYRDWAAYKQGFGSQLGGNSLTGHNNNFFSTKDQDNDVSSSNCAEKFQGAWWYADCHASNLNGLYLMGPHESYANGINWSAAKGYKYSYKVSEMKVRPA

SEQ ID NO: 96 - DNA, 900 bp, Homo sapiens
  CDS (1)..(897)
ggatccgcggacacatgtccagaggtgaaggtggtgggcctggagggctctgacaagctcaccattctccgaggctgcccggggctgcccggggccccagggccaaagggagaggcaggtgtcattggagagagaggagaacgcggtctccctggagcccctggaaaggcaggaccagtggggcccaaaggagaccgaggagagaaggggatgcgtggagagaaaggagacgctgggcagtctcagtcgtgtgcgacaggcccacgcaactgcaaggacctgctagaccgggggtatttcctgagcggctggcacaccatctacctgcccgactgccggcccctgactgtgctctgtgacatggacacggacggagggggctggaccgttttccagcggaggatggatggctctgtggacttctatcgggactgggccgcatacaagcagggcttcggcagtcagctgggggagttctggctggggaacgacaacatccacgccctgactgcccagggaagcagcgagctccgtgtagacctggtggactttgagggcaaccaccagtttgctaagtacaaatcattcaaggtggctgacgaggcagagaagtacaagctggtactgggagcctttgtcgggggcagtgcgggtaattctctaacgggccacaacaacaacttcttctccaccaaagaccaagacaatgatgtgagttcttcgaattgtgctgagaagttccagggagcctggtggtacgccgactgtcatgcttcaaacctcaatggtctctacctcatgggaccccatgagagctatgccaatggtatcaactggagtgcggcgaaggggtacaaatatagctacaaggtgtcagagatgaaggggcccgccctcgag

SEQ ID NO: 97 - protein, 299 aa, Homo sapiens
GSADTCPEVKVVGLEGSDKLTILRGCPGLPGAPGPKGEAGVIGERGERGLPGAPGKAGPVGPKGDRGEKGMRGEKGDAGQSQSCATGPRNCKDLLDRGYFLSGWHTIYLPDCRPLTVLCDMDTDGGGWTVFQRRMDGSVDFYRDWAAYKQGFGSQLGEFWLGNDNIHALTAQGSSELRVDLVDFEGNHQFAKYKSFKVADEAEKYKLVLGAFVGGSAGNSLTGHNNNFFSTKDQDNDVSSSNCAEKFQGAWWYADCHASNLNGLYLMGPHESYANGINWSAAKGYKYSYKVSEMKGPAL

SEQ ID NO: 98 - DNA, 779 bp, Homo sapiens
  CDS (16)..(624)
ctgagtggagccaccatggcccgggggctcgctgtcctgctagtcttgttcctgcatatcaagaacctgcctgcccaggctgcggacacatgtccagaggtgaaggtggtgggcctggagggctctgacaagctcaccattctccgaggctgcccggggctgcccggggccccagggccaaagggagaggcaggtgtcattggagagagaggagaacgcggtctccctggagcccctggaaaggcaggaccagtggggcccaaaggagaccgaggagagaaggggatgcgtggagagaaaggagacgctgggcagtctcagtcgtgtgcgacaggcccacgcaactgcaaggacctgctagaccgggggtatttcctgagcggctggcacaccatctacctgcccgactgccggcccctgactgtgctctgtgacatggacacggacggagggggctggaccgttttccagggagcctggtggtacgccgactgtcatgcttcaaacctcaatggtctctacctcatgggaccccatgagagctatgccaatggtatcaactggagtgcggcgaaggggtacaaatatagctacaaggtgtcagagatgaaggtgcggcccgcctagacgggccaggacccctccacatgcacctgctagtggggaggccacacccacaagcgctgcgtcgtggaagtcaccccatttccccagccagacacactcccatgacgcccacagctgcccctttgcccccagctcagtcaagccgccacatg

SEQ ID NO: 99 - protein, 203 aa, Homo sapiens
MARGLAVLLVLFLHIKNLPAQAADTCPEVKVVGLEGSDKLTILRGCPGLPGAPGPKGEAGVIGERGERGLPGAPGKAGPVGPKGDRGEKGMRGEKGDAGQSQSCATGPRNCKDLLDRGYFLSGWHTIYLPDCRPLTVLCDMDTDGGGWTVFQGAWWYADCHASNLNGLYLMGPHESYANGINWSAAKGYKYSYKVSEMKVRPA

SEQ ID NO: 100 - DNA, 1551 bp, Homo sapiens
  CDS (108)..(1511)
gcggccgcgggagctgaccctgcggggtcccggggggggagggggagccgcgaagcccccactgaggccgccgctgccgggcctcccctcccccccgggcgggcgccatgcgggggagcccgggcgacgcggagcggcggcagcgctggggtcgcctgttcgaggagctggacagtaacaaggatggccgcgtggacgtgcacgagttgcgccaggggctggccaggctgggcgggggcaacccagaccccggcgcccaacagggtatctcctctgagggtgatgctgacccagatggcgggctcgacctggaggaattttcccgctatctgcaggagcgggaacagcgtctgctgctcatgtttcacagtcttgaccggaaccaggatggtcacattgatgtctctgagatccaacagagtttccgagctctgggcatttccatctcgctggagcaggctgagaaaattttgcacagcatggaccgagacggcacaatgaccattgactggcaagaatggcgcgaccacttcctgttgcattcgctggaaaatgtggaggacgtgctgtatttctggaagcattccacggtcctggacattggcgagtgcctgacagtgccggacgagttctcaaagcaagagaagctgacgggcatgtggtggaaacagctggtggccggcgcagtggcaggtgccgtgtcacggacaggcacggcccctctggaccgcctcaaggtcttcattcaggtccatgcctcaaagaccaaccggctgaacatccttggggggcttcgaagcatggtccttgagggaggcatccgctgcctgtggcgcggcaatggtattaatgtactcaagattgcccccgagtcagctatcaagttcatggcctatgaacaggtgaggagggccatcctggggcagcaggagacactgcatgtgcaggagcgcttcgtggctggctccctggctggtgccacagcccaaaccatcatttaccctatggaggtgctgaagacgcggctgaccttgcgccggacgggccagtataaggggctgctggactgcgccaggcgtatcctggagagggaggggccccgtgccttctaccgcggctacctccccaacgtgctgggcatcatcccctatgcgggcatcgacctggccgtctacgaggtcctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaagcctccatcgagggtggcccccagctgtccatgctgggtctgctacgtcacatcctgtcccaggagggcatgcggggcctctaccgggggatcgcccccaacttcatgaaggttattccagctgtgagcatctcctatgtggtctacgagaacatgaagcaggccttgggggtcacgtccaggtgagggacccggagcccgtccccccaatccctcacccccc

SEQ ID NO: 101 - protein, 468 aa, Homo sapiens
MRGSPGDAERRQRWGRLFEELDSNKDGRVDVHELRQGLARLGGGNPDPGAQQGISSEGDADPDGGLDLEEFSRYLQEREQRLLLMFHSLDRNQDGHIDVSEIQQSFRALGISISLEQAEKILHSMDRDGTMTIDWQEWRDHFLLHSLENVEDVLYFWKHSTVLDIGECLTVPDEFSKQEKLTGMWWKQLVAGAVAGAVSRTGTAPLDRLKVFIQVHASKTNRLNILGGLRSMVLEGGIRCLWRGNGINVLKIAPESAIKFMAYEQVRRAILGQQETLHVQERFVAGSLAGATAQTIIYPMEVLKTRLTLRRTGQYKGLLDCARRILEREGPRAFYRGYLPNVLGIIPYAGIDLAVYEVLKNWWLQQYSHDSADPGILVLLACGTISSTCGQIASYPLALVRTRMQAQASIEGGPQLSMLGLLRHILSQEGMRGLYRGIAPNFMKVIPAVSISYVVYENMKQALGVTSR

SEQ ID NO: 102 - DNA, 1900 bp, Homo sapiens
  CDS (51)..(1850)
ttgcccctcagtccctcgggctcatacctagtgcctgcggcaggacagccatggccgccaactccaccagcgacctccacactcccgggacgcagctgagcgtggctgacatcatcgtcatcactgtgtattttgctctgaacgtggccgtgggcatatggtcctcttgtcgggccagtaggaacacggtgaatggctacttcctggcaggccgggacatgacgtggtggccgattggagcctccctcttcgccagcagcgagggctctggcctcttcattggactggcgggctcaggcgcggcaggaggtctggccgtggcaggcttcgagtggaatgccacgtacgtgctgctggcactggcatgggtgttcgtgcccatctacatctcctcagagatcgtcaccttacctgagtacattcagaagcgctacgggggccagcggatccgcatgtacctgtctgtcctgtccctgctactgtctgtcttcaccaagatatcggccctggacctgtacgcgggggctctgtttgtgcacatctgcctgggctggaacttctacctctccaccatcctcacgctcggcatcacagccctgtacaccatcgcaggtactggcggcctggctgctgtaatctacacggacgccctgcagacgctcatcatggtggtgggggctgtcatcctgacaatcaaagcttttgaccagatcggtggttacgggcagctggaggcagcctacgcccaggccattccctccaggaccattgccaacaccacctgccacctgccacgtacagacgccatgcacatgtttcgagacccccacacaggggacctgccgtggaccgggatgacctttggcctgaccatcatggccacctggtactggtgcaccgaccaggtgatcgtgcagcgatcactgtcagcccgggacctgaaccatgccaaggcgggctccatcctggccagctacctcaagatgctccccatgggcctgatcatcatgccgggcatgatcagccgcgcattgttcccagatgatgtgggctgcgtggtgccgtccgagtgcctgcgggcctgcggggccgaggtcggctgctccaacatcgcctaccccaagctggtcatggaactgatgcccatcggtctgcgggggctgatgatcgcagtgatgctggcggcgctcatgtcgtcgctgacctccatcttcaacagcagcagcaccctcttcactatggacatctggaggcggctgcgtccccgctccggcgagcgggagctcctgctggtgggacggttggtcatagtggcactcatcggcgtgagtgtggcctggatccccgtcctgcaggactccaacagcgggcaactcttcatctacatgcagtcagtgaccagctccctggccccaccagtgactgcagtctttgtcctgggcgtcttctggcgacgtgccaacgagcagcagggggccttctggggcctgatagcagggctggtggtgggggccacgaggctggtcctggaattcctgaacccagccccaccgtgcggagagccagacacgcggccagccgtcctggggagcatccactacctgcacttcgctgtcgccctctttgcactcagtggtgctgttgtggtggctggaagcctgctgaccccacccccacagagtgtccagattgagaaccttacctggtggaccctggctcaggatgtgcccttgggaactaaagcaggtgatggccaaacaccccagaaacacgccttctgggcccgtgtctgtggcttcaatgccatcctcctcatgtgtgtcaacatattcttttatgcctacttcgcctgacactgccatcctggacagaaaggcaggagctctgagtcctcaggtcc

SEQ ID NO: 103 - protein, 600 aa, Homo sapiens
MAANSTSDLHTPGTQLSVADIIVITVYFALNVAVGIWSSCRASRNTVNGYFLAGRDMTWWPIGASLFASSEGSGLFIGLAGSGAAGGLAVAGFEWNATYVLLALAWVFVPIYISSEIVTLPEYIQKRYGGQRIRMYLSVLSLLLSVFTKISALDLYAGALFVHICLGWNFYLSTILTLGITALYTIAGTGGLAAVIYTDALQTLIMVVGAVILTIKAFDQIGGYGQLEAAYAQAIPSRTIANTTCHLPRTDAMHMFRDPHTGDLPWTGMTFGLTIMATWYWCTDQVIVQRSLSARDLNHAKAGSILASYLKMLPMGLIIMPGMISRALFPDDVGCVVPSECLRACGAEVGCSNIAYPKLVMELMPIGLRGLMIAVMLAALMSSLTSIFNSSSTLFTMDIWRRLRPRSGERELLLVGRLVIVALIGVSVAWIPVLQDSNSGQLFIYMQSVTSSLAPPVTAVFVLGVFWRRANEQQGAFWGLIAGLVVGATRLVLEFLNPAPPCGEPDTRPAVLGSIHYLHFAVALFALSGAVVVAGSLLTPPPQSVQIENLTWWTLAQDVPLGTKAGDGQTPQKHAFWARVCGFNAILLMCVNIFFYAYFA

SEQ ID NO: 104 - DNA, 2147 bp, Homo sapiens
  CDS (66)..(2117)
ttaaaggaaaggaatgaagccaggagcgcctcaaagtccagcctgctgttgaccaacactaacagatgagcaaggagctggcagcaatggggcctggagcttcaggggacggggtcaggactgagacagctccacacatagcactggactccagagttggtctgcacgcctacgacatcagcgtggtggtcatctactttgtcttcgtcattgctgtggggatctggtcgtccatccgtgcaagtcgagggaccattggcggctatttcctggccgggaggtccatgagctggtggccagtgggagcatctctgatgtccagcaatgtgggcagtggcttgttcatcggcctggctgggacaggggctgccggaggccttgccgtaggtggcttcgagtggaacgtaaggaagctggcctggtttctcgtcttcgtccctgtgtacatcgcagcaggtgtggtcacaatgccgcagtatctgaagaagcgatttgggggccagaggatccaggtgtacatgtctgtcctgtctctcatcctctacatcttcaccaagatctcggtagacatcttctctggagccctcttcatccagatggcattgggctggaacctgtacctctccacagggatcctgctggtggtgactgccgtctacaccattgcaggtggcctcatggccgtgatctacacagatgctctgcagacggtgatcatggtagggggagccctggtcctcatgtttcaggacgtgggctggtacccaggcctggagcagcggtacaggcaggccatccctaatgtcacagtccccaacaccacctgtcacctcccacggcccgatgctttccacattcttcgggaccctgtgagcggggacatcccttggccaggtctcattttcgggctcacagtgctggccacctggtgttggtgcacagaccaggtcattgtgcagcggtctctctcggccaagagtctgtctcatgccaagggaggctccgtgctggggggctacctgaagatcctccccatgttcttcatcgtcatgcctggcatgatcagccgggccctgttcccagacgaggtgggctgcgtggaccctgatgtctgccaaagaatctgtggggcccgagtgggatgttccaacattgcctaccctaagttggtcatggccctcatgcctgttggtcgggggctgatgattgccgtgatcatggccgctctcatgagctcactcacctccatcttcaacagcagcagcaccctgttcaccattgatgtgtggcagcgcttccgcaggaagtcaacagagcaggagctgatggtggtgggcagggtgtttgtggtgttcctggttgtcatcagcatcctctggatccccatcatccaaagctccaacagtgggcagctcttcgactacatccaggctgtcaccagttacctggccccacccatcaccgctctcttcctgctggccatcttctgcaagagggtcacagagcagggagctttctggggcctcgtgtttggcctgggagtggggcttctgcgtatgatcctggagttctcatacccagcgccagcctgtggggaggtggaccggaggccagcagtgctgaaggacttccactacctgtactttgcaatcctcctctgcgggctcactgccatcgtcattgtcattgtcagcctctgtacaactcccatccctgaggaacaggcaagtcgcctcacatggtggactcggaactgccccctctctgagctggagaaggaggcccccccatactttccatcagtatctcaccatctctctccctcccctactctcctatcactttcctttctccaatcttctttgcctctcccctcctgctctcctttgtcttctggctttgtccctccagccccaagcaggtcctggggaaagttgctctggagctggttctgtgggctctctggaacaccggagcaggccctgagcccagcagagaaggctgcgctagaacagaagctgacaagcattgaggaggagccactctggagacatgtctgcaacatcaatgctgtccttttgctggccatcaacatcttcctctggggctattttgcgtgattccacagacctggcttcagtgtagac

SEQ ID NO: 105 - protein, 684 aa, Homo sapiens
MSKELAAMGPGASGDGVRTETAPHIALDSRVGLHAYDISVVVIYFVFVIAVGIWSSIRASRGTIGGYFLAGRSMSWWPVGASLMSSNVGSGLFIGLAGTGAAGGLAVGGFEWNVRKLAWFLVFVPVYIAAGVVTMPQYLKKRFGGQRIQVYMSVLSLILYIFTKISVDIFSGALFIQMALGWNLYLSTGILLVVTAVYTIAGGLMAVIYTDALQTVIMVGGALVLMFQDVGWYPGLEQRYRQAIPNVTVPNTTCHLPRPDAFHILRDPVSGDIPWPGLIFGLTVLATWCWCTDQVIVQRSLSAKSLSHAKGGSVLGGYLKILPMFFIVMPGMISRALFPDEVGCVDPDVCQRICGARVGCSNIAYPKLVMALMPVGRGLMIAVIMAALMSSLTSIFNSSSTLFTIDVWQRFRRKSTEQELMVVGRVFVVFLVVISILWIPIIQSSNSGQLFDYIQAVTSYLAPPITALFLLAIFCKRVTEQGAFWGLVFGLGVGLLRMILEFSYPAPACGEVDRRPAVLKDFHYLYFAILLCGLTAIVIVIVSLCTTPIPEEQASRLTWWTRNCPLSELEKEAPPYFPSVSHHLSPSPTLLSLSFLQSSLPLPSCSPLSSGFVPPAPSRSWGKLLWSWFCGLSGTPEQALSPAEKAALEQKLTSIEEEPLWRHVCNINAVLLLAINIFLWGYFA

SEQ ID NO: 106 - DNA, 797 bp, Homo sapiens
  CDS (19)..(774)
agcaaggagctggcagcaatggggcctggagcttcaggggacggggtcaggactgagacagctccacacatagcactggactccagagttggtctgcacgcctacgacatcagcgtggtggtcatctactttgtcttcgtcattgctgtggggatctggtcgtccatcttctgcaagagggtcacagagcccggagctttctggggcctcgtgtttggcctgggagtggggcttctgcgtatgatcctggagttctcatacccagcgccagcctgtggggaggtggaccggaggccagcagtgctgaaggacttccactacctgtactttgcaatcctcctctgcgggctcactgccatcgtcattgtcattgtcagcctctgtacaactcccatccctgaggaacagctcacacgcctcacatggtggactcggaactgccccctctctgagctggagaaggaggcccacgagagcacaccggagatatccgagaggccagccggggagtgccctgcaggaggtggagcggcagagaactcgagcctgggccaggagcagcctgaagccccaagcaggtcctggggaaagttgctctggagctggttctgtgggctctctggaacaccggagcaggccctgagcccagcagagaaggctgcgctagaacagaagctgacaagcattgaggaggagccactctggagacatgtctgcaacatcaatgctgtccttttgctggccatcaacatcttcctctggggctattttgcgtgattccacagacctggcttcag

SEQ ID NO: 107 - protein, 252 aa, Homo sapiens
MGPGASGDGVRTETAPHIALDSRVGLHAYDISVVVIYFVFVIAVGIWSSIFCKRVTEPGAFWGLVFGLGVGLLRMILEFSYPAPACGEVDRRPAVLKDFHYLYFAILLCGLTAIVIVIVSLCTTPIPEEQLTRLTWWTRNCPLSELEKEAHESTPEISERPAGECPAGGGAAENSSLGQEQPEAPSRSWGKLLWSWFCGLSGTPEQALSPAEKAALEQKLTSIEEEPLWRHVCNINAVLLLAINIFLWGYFA

SEQ ID NO: 108 - DNA, 2278 bp, Homo sapiens
  CDS (20)..(2248)
gagcaaggagctggcagcaatggggcctggagcttcaggggacggggtcaggactgagacagctccacacatagcactggactccggagttggtctgcacgcctacgacatcagcgtggtggtcatctactttgtcttcgtcattgctgtggggatctggtcgtccatccgtgcaagtcgagggaccattggcggctatttcctggccgggaggtccatgagctggtggccaattggagcatctctgatgtccagcaatgtgggcagtggcttgttcatcggcctggctgggacaggggctgccggaggccttgccgtaggtggcttcgagtggaacatgaggaaatcaaggtctggaggagacagagggatccatccaaggtcacacgggaggactggggtcaggtcccaggtctcttatttctctgttcgggggcctcccacagcacagcactgcctctgggtgggaagccgcccctctgtctacatccaggacctggataccttcttcttctccccactctcccaggcaacctggctgctcctggcccttggctgggtcttcgtccctgtgtacatcgcagcaggtgtggtcacaatgccgcagtatctgaagaagcgatttgggggccagaggatccaggtgtacatgtctgtcctgtctctcatcctctacatcttcaccaagatctcgactgacatcttctctggagcccccttcatccagatggcattgggctggaacctgtacctctccacagggatcctgctggtggtgactgccgtctacaccattgcaggtggcctcatggccgtgatctacacagatgctctgcagacggtgatcatggtagggggagccctggtcctcatgtttcaggacgtgggctggtacccaggcctggagcagcggtacaggcaggccatccctaatgtcacagtccccaacaccacctgtcacctcccacggcccgatgctttccacattcttcgggaccctgtgagcggggacatcccttggccaggtctcattttcgggctcacagtgctggccacctggtgttggtgcacagaccaggtcattgtgcagcggtctctctcggccaagagtctgtctcatgccaagggaggctccgtgctggggggctacctgaagatcctccccatgttcttcatcgtcatgcctggcatgatcagccgggccctgttcccagacgaggtgggctgcgtggaccctgatgtctgccaaagaatctgtggggcccgagtgggatgttccaacattgcctaccctaagttggtcatggccctcatgcctgttggtcgggggctgatgattgccgtgatcatggccgctctcatgagctcactcacctccatcttcaacagcagcagcaccctgttcaccattgatgtgtggcagcgcttccgcaggaagtcaacagagcaggagctgatggtggtgggcagggtgtttgtggtgttcctggttgtcatcagcatcctctggatccccatcatccaaagctccaacagtgggcagctcttcgactacatccaggctgtcaccagttacctggccccacccatcaccgctctcttcctgctggccatcttctgcaagagggtcacagagcagggagctttctggggcctcgtgtttggcctgggagtggggcttctgcgtatgatcctggagttctcatacccagcgccagcctgtggggaggtggaccggaggccagcagtgctgaaggacttccactacctgtactttgcaatcctcctctgcgggctcactgccatcgtcattgtcattgtcagcctctgtacaactcccatccctgaggaacaggcaagtcgcctcacatggtggactcggaactgccccctctctgagctggagaaggaggcccccccatactttccatcagtatctcaccatctctctccctcccctactctcctatcactttcctttctccaatcttctttgcctctcccctcctgctctcctttgtcttctggctttgtccctccagccccaagcaggtcctggggaaagttgctctggagctggttctgtgggctctctggaacaccggagcaggccctgagcccagcagagaaggctgcgctagaacagaagctgacaagcattgaggaggagccactctggagacatgtctgcaacatcaatgctgtccttttgctggccatcaacatcttcctctggggctattttgcgtgattccacagacctggcttcagtgtagac

SEQ ID NO: 109 - protein, 743 aa, Homo sapiens
MGPGASGDGVRTETAPHIALDSGVGLHAYDISVVVIYFVFVIAVGIWSSIRASRGTIGGYFLAGRSMSWWPIGASLMSSNVGSGLFIGLAGTGAAGGLAVGGFEWNMRKSRSGGDRGIHPRSHGRTGVRSQVSYFSVRGPPTAQHCLWVGSRPSVYIQDLDTFFFSPLSQATWLLLALGWVFVPVYIAAGVVTMPQYLKKRFGGQRIQVYMSVLSLILYIFTKISTDIFSGAPFIQMALGWNLYLSTGILLVVTAVYTIAGGLMAVIYTDALQTVIMVGGALVLMFQDVGWYPGLEQRYRQAIPNVTVPNTTCHLPRPDAFHILRDPVSGDIPWPGLIFGLTVLATWCWCTDQVIVQRSLSAKSLSHAKGGSVLGGYLKILPMFFIVMPGMISRALFPDEVGCVDPDVCQRICGARVGCSNIAYPKLVMALMPVGRGLMIAVIMAALMSSLTSIFNSSSTLFTIDVWQRFRRKSTEQELMVVGRVFVVFLVVISILWIPIIQSSNSGQLFDYIQAVTSYLAPPITALFLLAIFCKRVTEQGAFWGLVFGLGVGLLRMILEFSYPAPACGEVDRRPAVLKDFHYLYFAILLCGLTAIVIVIVSLCTTPIPEEQASRLTWWTRNCPLSELEKEAPPYFPSVSHHLSPSPTLLSLSFLQSSLPLPSCSPLSSGFVPPAPSRSWGKLLWSWFCGLSGTPEQALSPAEKAALEQKLTSIEEEPLWRHVCNINAVLLLAINIFLWGYFA

SEQ ID NO: 110 - DNA, 1969 bp, Homo sapiens
  CDS (19)..(846)
agcaaggagctggcagcaatggggcctggagcttcaggggacggggtcaggactgagacagctccacacatagcactggactccagagttggtctgcacgcctacgacatcagcgtggtggtcatctactttgtcttcgtcattgttgtggggatctggtcgtccatccgtgcaagtcgagggaccattggcggctatttcctggccccacccatcaccgctctcttcctgctggccatcttctgcaagagggtcacagagcccggagctttctggggcctcgtgtttggcctgggagtggggcttctgcgtatgatcctggagttctcatacccagcgccagcctgtggggaggtggaccggaggccagcagtgctgaaggacttccactacctgtactttgcaatcctcctctgcgggctcactgccatcgtcattgtcattgtcagcctctgtacaactcccatccctgaggaacagctcacacgcctcacatggtggactcggaactgccccctctctgagctggagaaggaggcccacgagagcacaccggagatatccgagaggccagccggggagtgccctgcaggaggtggagcggcagagaactcgagcctgggccaggagcagcctgaagccccaagcaggtcctggggaaagttgctctggagctggttctgtgggctctctggaacaccggagcaggccctgagcccagcagagaaggctgcgctagaacagaagctgacaagcattgaggaggagccactctggagacatgtctgcaacatcaatgctgtccttttgctggccatcaacatcttcctctggggctattttgcgtgattccacagacctggcttcagtgtagacagattaaacaaagcccaagcctgtcagccacagaaacaggctctcctcttactttgctgtctaaactggagatcacagaagtcaagactgcaagctcccctgaagagaatccaactcaacctgcacacttgacaagtggagaaacagaagctcagagagagcactgggtttgttcaggaccacccagaaggtgtcacacggggtttccccactctttctgatatattgccttacagacctacctcaaacacactgtttccaccctcttcttgaatgtattcagtagcctttactgaatgtgtgtcttgagagtagaaaaatggaggatacaagaaaaggagcaggaagaaatttgcaaaaatccaagagcacctttgctcccccttatcctccttcctcttcccctttctagttcccctacctctctatctttctattctcaccaataatctctttgttgcatgaatttacccaggagagtcctatatttccattggtggctccacagtggtggctgtcagacccgaaggggtggggagccaagggtggactttaagcatggtgacagatggtattttgggcagaaagctcttagacaatggactatccaaagcactatttaaattctgcctcttcctactctctaacccaaatatgcacaaactctctatggccttgagaagcagttggagagacatgacttgttaaaacctcaaggaatcaagacatgttactctgtatttaagggtaagccccacagcgggcagcacaaacagcctgggagccactgtgcctgtgcttctctgtccttctccctttgcttgccatgaatccgcataccttggaatacactgtgaccccagttaagtgtcccttcgccaggaagctgccgcaacgtccagacctgggtcaagttcccactcctgctcccatagccttgacctgcttctgtcacagcactgatcacactgagatggaagactccagggggcaaggaccaagggccatatcccaagtgactttgtacccagaaaataacagctgttcaataaatgtgtattgagttaattagttaaaaaaaaaaaaaaaaaaa

SEQ ID NO: 111 - protein, 276 aa, Homo sapiens
MGPGASGDGVRTETAPHIALDSRVGLHAYDISVVVIYFVFVIVVGIWSSIRASRGTIGGYFLAPPITALFLLAIFCKRVTEPGAFWGLVFGLGVGLLRMILEFSYPAPACGEVDRRPAVLKDFHYLYFAILLCGLTAIVIVIVSLCTTPIPEEQLTRLTWWTRNCPLSELEKEAHESTPEISERPAGECPAGGGAAENSSLGQEQPEAPSRSWGKLLWSWFCGLSGTPEQALSPAEKAALEQKLTSIEEEPLWRHVCNINAVLLLAINIFLWGYFA

SEQ ID NO: 112 - DNA, 2162 bp, Homo sapiens
  CDS (21)..(2132)
tgagcaaggagctggcagcaatggggcctggagcttcaggggacggggtcaggactgagacagctccacacatagcactggactccagagttggtctgcacgcctacgacatcagcgtggtggtcatctactttgtcttcgtcattgctgtggggatctggtcgtccatccgtgcaagtcgagggaccattggcggctatttcctggccgggaggtccatgagctggcggccaattggagcatctctgatgtccagcaatgtgggcagtggcttgttcatcggcctggctgggacaggggctgccggaggccttgccgtaggtggcttcgagtggaacatgaggaaatcaaggtctggaggagacagagggatccatccaaggtcacacgggaggactggggtcaggtcccaggcaacctggctgctcctggcccttggctgggtcttcgtccctgtgtacatcgcagcaggtgtggtcacaatgccgcagtatctgaagaagcgatttgggggccagaggatccaggtgtacatgtctgtcctgtctctcatcctctacatcttcaccaagatctcgactgacatcttctctggagccctcttcatccagatggcattgggctggaacctgtacctctccacagggatcctgctggtggtgactgccgtctacaccattgcaggtggcctcatggccgtgatctacacagatgctctgcagacggtgatcatggtagggggagccctggtcctcatgtttcaggacgtgggctggtacccaggcctggagcagcggtacaggcaggccatccctaatgtcacagtccccaacaccacctgtcacctcccacggcccgatgctttccacattcttcgggaccctgtgagcggggacatcccttggccaggtctcattttcgggctcacagtgctggccacctggtgttggtgcacagaccaggtcattgtgcagcggtctctctcggccaagagtctgtctcatgccaagggaggctccgtgctggggggctacctgaagatcctccccatgttcttcatcgtcatgcctggcatgatcagccgggccctgttcccagacgaggtgggctgcgtggaccctgatgtctgccaaagaatctgtggggcccgagtgggatgttccaacattgcctaccctaagttggtcatggccctcatgcctgttggtcgggggctgatgattgccgtgatcatggccgctctcatgagctcactcacctccatcttcaacagcagcagcaccctgttcaccattgatgtgtggcagcgcttccgcaggaagtcaacagagcaggagctgatggtggtgggcagggtgtttgtggtgttcctggttgtcatcagcatcctctggatccccatcatccaaagctccaacagtgggcagctcttcgactacatccaggctgtcaccagttacctggccccacccatcaccgctctcttcctgctggccatcttctgcaagagggtcacagagcagggagctttctggggcctcgtgtttggcctgggagtggggcttctgcgtatgatcctggagttctcatacccagcgccagcctgtggggaggtggaccggaggccagcagtgctgaaggacttccactacctgtactttgcaatcctcctctgcgggctcactgccatcgtcattgtcattgtcagcctctgtacaactcccatccctgaggaacaggcaagtcgcctcacatggtggactcggaactgccccctctctgagctggagaaggaggcccccccatactttccatcagtatctcaccatctctctccctcccctactctcctatcactttcctttctccaatcttctttgcctctcccctcctgctctcctttgtcttctggctttgtccctccagccccaagcaggtcctggggaaagttgctctggagctggttctgtgggctctctggaacaccggagcaggccctgagcccagcagagaaggctgcgctagaacagaagctgacaagcattgaggaggagccactctggagacatgtctgcaacatcaatgctgtccttttgctggccatcaacatcttcctctggggctattttgcgtgattccacagacctggcttcagtgtagac

SEQ ID NO: 113 - protein, 704 aa, Homo sapiens
MGPGASGDGVRTETAPHIALDSRVGLHAYDISVVVIYFVFVIAVGIWSSIRASRGTIGGYFLAGRSMSWRPIGASLMSSNVGSGLFIGLAGTGAAGGLAVGGFEWNMRKSRSGGDRGIHPRSHGRTGVRSQATWLLLALGWVFVPVYIAAGVVTMPQYLKKRFGGQRIQVYMSVLSLILYIFTKISTDIFSGALFIQMALGWNLYLSTGILLVVTAVYTIAGGLMAVIYTDALQTVIMVGGALVLMFQDVGWYPGLEQRYRQAIPNVTVPNTTCHLPRPDAFHILRDPVSGDIPWPGLIFGLTVLATWCWCTDQVIVQRSLSAKSLSHAKGGSVLGGYLKILPMFFIVMPGMISRALFPDEVGCVDPDVCQRICGARVGCSNIAYPKLVMALMPVGRGLMIAVIMAALMSSLTSIFNSSSTLFTIDVWQRFRRKSTEQELMVVGRVFVVFLVVISILWIPIIQSSNSGQLFDYIQAVTSYLAPPITALFLLAIFCKRVTEQGAFWGLVFGLGVGLLRMILEFSYPAPACGEVDRRPAVLKDFHYLYFAILLCGLTAIVIVIVSLCTTPIPEEQASRLTWWTRNCPLSELEKEAPPYFPSVSHHLSPSPTLLSLSFLQSSLPLPSCSPLSSGFVPPAPSRSWGKLLWSWFCGLSGTPEQALSPAEKAALEQKLTSIEEEPLWRHVCNINAVLLLAINIFLWGYFA

SEQ ID NO: 114 - DNA, 875 bp, Homo sapiens
  CDS (19)..(846)
agcaaggagctggcagcaatggggcctggagcttcaggggacggggtcaggactgagacagctccacacatagcactggactccagagttggtctgcacgcctacgacatcagcgtggtggtcatctactttgtcttcgtcattgttgtggggatctggtcgtccatccgtgcaagtcgagggaccattggcggctatttcctggccccacccatcaccgctctcttcctgctggccatcttctgcaagagggtcacagagcccggagctttctggggcctcgtgtttggcctgggagtggggcttctgcgtatgatcctggagttctcatacccagcgccagcctgtggggaggtggaccggaggccagcagtgctgaaggacttccactacctgtactttgcaatcctcctctgcgggctcactgccatcgtcattgtcattgtcagcctctgtacaactcccatccctgaggaacagctcacacgcctcacatggtggactcggaactgccccctctctgagctggagaaggaggcccacgagagcacaccggagatatccgagaggccagccggggagtgccctgcaggaggtggagcggcagagaactcgagcctgggccaggagcagcctgaagccccaagcaggtcctggggaaagttgctctggagctggttctgtgggctctctggaacaccggagcaggtcctgagcccagcagagaaggctgcgctagaacagaagctgacaagcattgaggaggagccactctggagacatgtctgcaacatcaatgctgtccttttgctggccatcaacatcttcctctggggctattttgcgtgattccacagacctggcttcagtgtaga

SEQ ID NO: 115 - protein, 276 aa, Homo sapiens [sequence omitted]

SEQ ID NO: 116 - DNA, 2105 bp, Homo sapiens
  CDS (31)..(2055)
cctcaggatccagaggtctcgttcaggaccatggagagcggcaccagcagccctcagcctccacagttagatcccctggatgcgtttccccagaagggcttggagcctggggacatcgcggtgctagttctgtacttcctctttgtcctggctgttggactatggtccacagtgaagaccaaaagagacacagtgaaaggctacttcctggctggaggggacatggtgtggtggccagtgggtgcatccttgtttgccagcaatgttggaagtggacatttcattggcctggcagggtcaggtgctgctacgggcatttctgtatcagcttatgaacttaatggcttgttttctgtgctgatgttggcctggatcttcctacccatctacattgctggtcaggtgaccacgatgccagaatacctacggaagcgcttcggtggcatcagaatccccatcatcctggctgtactctacctatttatctacatcttcaccaagatctcggtagacatgtatgcaggtgccatcttcatccagcagtctttgcacctggatctgtacctggccatagttgggctactggccatcactgctgtatacacggttgctggtggcctggctgctgtgatctacacggatgccctgcagacgctgatcatgcttataggagcgctcaccttgatgggctacagtttcgccgcggttggtgggatggaaggactgaaggagaagtacttcttggccctggctagcaaccggagtgagaacagcagctgcgggctgccccgggaagatgccttccatattttccgagatccgctgacatctgatctcccgtggccgggggtcctatttggaatgtccatcccatccctctggtactggtgcacggatcaggtaattgtccagcggactctggctgccaagaacctgtcccatgccaaaggaggtgctctgatggctgcatacctgaaggtgctgcccctcttcataatggtgttccctgggatggtcagccgcatcctcttcccagatcaagtggcctgtgcagatccagagatctgccagaagatctgcagcaacccctcaggctgttcggacatcgcgtatcccaaactcgtgctggaactcctgcccacaggtctccgtgggctgatgatggctgtgatggtggcggctctcatgtcctccctcacctccatctttaacagtgccagcaccatcttcaccatggacctctggaatcacctccggcctcgggcatctgagaaggagctcatgattgtgggcagggtgtttgtgctgctgctggtcctggtctccatcctctggatccctgtggtccaggccagccagggcggccagctcttcatctatatccagtccatcagctcctacctgcagccgcctgtggcggtggtcttcatcatgggatgtttctggaagaggaccaatgaaaagggtgccttctggggcctgatctcgggcctgctcctgggcttggttaggctggtcctggactttatttacgtgcagcctcgatgcgaccagccagatgagcgcccggtcctggtgaagagcattcactacctctacttctccatgatcctgtccacggtcaccctcatcactgtctccaccgtgagctggttcacagagccaccctccaaggagatggtcagccacctgacctggtttactcgtcacgaccccgtggtccagaaggaacaagcaccaccagcagctcccttgtctcttaccctctctcagaacgggatgccagaggccagcagcagcagcagcgtccagttcgagatggttcaagaaaacacgtctaaaacccacagcggtgacatgaccccaaagcagtccaaagtggtgaaggccatcctgtggctctgtggaatacaggagaagggcaaggaagagctcccggccagagcagaagccatcatagtttccctggaagaaaaccccttggtgaagaccctcctggacgtcaacctcattttctgcgtgagctgcgccatctttatctggggctattttgcttagtgtggggtgaacccaggggtccaaactctgtttctcttcagtgctcc

SEQ ID NO: 117 - protein, 675 aa, Homo sapiens
MESGTSSPQPPQLDPLDAFPQKGLEPGDIAVLVLYFLFVLAVGLWSTVKTKRDTVKGYFLAGGDMVWWPVGASLFASNVGSGHFIGLAGSGAATGISVSAYELNGLFSVLMLAWIFLPIYIAGQVTTMPEYLRKRFGGIRIPIILAVLYLFIYIFTKISVDMYAGAIFIQQSLHLDLYLAIVGLLAITAVYTVAGGLAAVIYTDALQTLIMLIGALTLMGYSFAAVGGMEGLKEKYFLALASNRSENSSCGLPREDAFHIFRDPLTSDLPWPGVLFGMSIPSLWYWCTDQVIVQRTLAAKNLSHAKGGALMAAYLKVLPLFIMVFPGMVSRILFPDQVACADPEICQKICSNPSGCSDIAYPKLVLELLPTGLRGLMMAVMVAALMSSLTSIFNSASTIFTMDLWNHLRPRASEKELMIVGRVFVLLLVLVSILWIPVVQASQGGQLFIYIQSISSYLQPPVAVVFIMGCFWKRTNEKGAFWGLISGLLLGLVRLVLDFIYVQPRCDQPDERPVLVKSIHYLYFSMILSTVTLITVSTVSWFTEPPSKEMVSHLTWFTRHDPVVQKEQAPPAAPLSLTLSQNGMPEASSSSSVQFEMVQENTSKTHSGDMTPKQSKVVKAILWLCGIQEKGKEELPARAEAIIVSLEENPLVKTLLDVNLIFCVSCAIFIWGYFA

SEQ ID NO: 118 - DNA, 1201 bp, Homo sapiens
  CDS (86)..(1039)
tcattgacacatgcttgaaagtaatcagagtaagataaatatttgtcttaacatgctctgtcttacaagctaaagagggagtaaaatggaatgggaaaaccacaccattctggtggaattttttctgaagggactttctggtcacccaagacttgagttactcttttttgtgctcatcttcataatgtatgtggtcatccttctggggaatggtactctcattttaatcagcatcttggaccctcaccttcacacccctatgtacttctttctggggaacctctccttcttggacatctgctacaccaccacctctattccctccacgctagtgagcttcctttcagaaagaaagaccatttccctttctggctgtgcagtgcagatgttcctcagcttggccatggggacaacagagtgtgtgcttctgggcgtgatggcctttgaccgctatgtggctatctgcaaccctctgagatatcccatcatcatgagtaaggatgcctatgtacccatggcagctgggtcctggatcataggagctgtcaattctgcagtacaaacagtgtttgtggtacaattgcctttctgcaggaataacatcatcaatcatttcacctgtgaaattctagctgtcatgaaactggcctgtgctgacatctcaggcaatgagttcatcctgcttgtgaccacaacattgttcctattgacacctttgttattaattattgtctcttacacgttaatcattttgagcatcttcaaaattagctcttcggaggggagaagcaaaccttcctctacctgctcagctcgtctgactgtggtgataacattctgtgggaccatcttcctcatgtacatgaagcccaagtctcaagagacacttaattcagatgacttggatgccactgacaaacttatattcatattctacagggtgatgactcccatgatgaatcctttaatctacagtcttagaaacaaggatgtgaaggaggcagtaaaacacctactgagaagaaaaaattttaacaagtaaatgagaaaggtgagagtaattttataatcacaatatggaaatcaattagagaaaccaaggttaaacagataggttctcgttgctgtttcacattcatctctcgaagttctaaagctccaaaatacacttctctgattgcgatacataatgaaaagaagt

SEQ ID NO: 119 - protein, 318 aa, Homo sapiens
MEWENHTILVEFFLKGLSGHPRLELLFFVLIFIMYVVILLGNGTLILISILDPHLHTPMYFFLGNLSFLDICYTTTSIPSTLVSFLSERKTISLSGCAVQMFLSLAMGTTECVLLGVMAFDRYVAICNPLRYPIIMSKDAYVPMAAGSWIIGAVNSAVQTVFVVQLPFCRNNIINHFTCEILAVMKLACADISGNEFILLVTTTLFLLTPLLLIIVSYTLIILSIFKISSSEGRSKPSSTCSARLTVVITFCGTIFLMYMKPKSQETLNSDDLDATDKLIFIFYRVMTPMMNPLIYSLRNKDVKEAVKHLLRRKNFNK

SEQ ID NO: 120 - DNA, 2069 bp, Homo sapiens
  CDS (67)..(1890)
cccgccttccatacctccccggctccgctcggttcctggccaccccgcagcccctgcccaggtgccatggccgcattgtaccgccctggcctgcggcttaactggcatgggctgagccccttgggctggccatcatgccgtagcatccagaccctgcgagtgcttagtggagatctgggccagcttcccactggcattcgagattttgtagagcacagtgcccgcctgtgccaaccagagggcatccacatctgtgatggaactgaggctgagaatactgccacactgaccctgctggagcagcagggcctcatccgaaagctccccaagtacaataactgctggctggcccgcacagaccccaaggatgtggcacgagtagagagcaagacggtgattgtaactccttctcagcgggacacggtaccactcccgcctggtggggcctgtgggcagctgggcaactggatgtccccagctgatttccagcgagctgtggatgagaggtttccaggctgcatgcagggccgcaccatgtatgtgcttccattcagcatgggtcctgtgggctccccgctgtcccgcatcggggtgcagctcactgactcagcctatgtggtggcaagcatgcgtattatgacccgactggggacacctgtgcttcaggccctgggagatggtgactttgtcaagtgtctgcactccgtgggccagcccctgacaggacaaggggagccagtgagccagtggccgtgcaacccagagaaaaccctgattggccacgtgcccgaccagcgggagatcatctccttcggcagcggctatggtggcaactccctgctgggcaagaagtgctttgccctacgcatcgcctctcggctggcccgggatgagggctggctggcagagcacatgctgatcctgggcatcaccagccctgcagggaagaaggcgctatgtgcagccgccttccctagtgcctgtggcaagaccaacctggctatgatgcggcctgcactgccaggctggaaagtggagtgtgtgggggatgatattgcttggatgaggtttgacagtgaaggtcgactccgggccatcaaccctgagaacggcttctttggggttgcccctggtacctctgccaccaccaatcccaacgccatggctacaatccagagtaacactatttttaccaatgtggctgagaccagtgatggtggcgtgtactgggagggcattgaccagcctcttccacctggtgttactgtgacctcctggctgggcaaaccctggaaacctggtgacaaggagccctgtgcacatcccaactctcgattttgtgccccggctcgccagtgccccatcatggacccagcctgggaggccccagagggtgtccccattgacgccatcatctttggtggccgcagacccaaagggaagatcatcatgcacgacccatttgccatgcggcccttttttggctacaacttcgggcactacctggaacactggctgagcatggaagggcgcaagggggcccagctgccccgtatcttccatgtcaactggttccggcgtgacgaggcagggcacttcctgtggccaggctttggggagaatgctcgggtgctagactggatctgccggcggttagagggggaggacagtgcccgagagacacccattgggctggtgccaaaggaaggagccttggatctcagcggcctcagagctatagacaccactcagctgttctccctccccaaggacttctgggaacaggaggttcgtgacattcggagctacctgacagagcaggtcaaccaggatctgcccaaagaggtgttggctgagcttgaggccctggagagacgtgtgcacaaaatgtgacctgaggcctagtctagcaagaggacatagcaccctcatctgggaatagggaaggcaccttgcagaaaatatgagcaattgatattaactaacatcttcaatgtgccatagaccttcccacaaagactgtccaataataagagatgcttatctattttaaaaaaaaaaaaaaaaaa

SEQ ID NO: 121 - protein, 608 aa, Homo sapiens
MAALYRPGLRLNWHGLSPLGWPSCRSIQTLRVLSGDLGQLPTGIRDFVEHSARLCQPEGIHICDGTEAENTATLTLLEQQGLIRKLPKYNNCWLARTDPKDVARVESKTVIVTPSQRDTVPLPPGGACGQLGNWMSPADFQRAVDERFPGCMQGRTMYVLPFSMGPVGSPLSRIGVQLTDSAYVVASMRIMTRLGTPVLQALGDGDFVKCLHSVGQPLTGQGEPVSQWPCNPEKTLIGHVPDQREIISFGSGYGGNSLLGKKCFALRIASRLARDEGWLAEHMLILGITSPAGKKALCAAAFPSACGKTNLAMMRPALPGWKVECVGDDIAWMRFDSEGRLRAINPENGFFGVAPGTSATTNPNAMATIQSNTIFTNVAETSDGGVYWEGIDQPLPPGVTVTSWLGKPWKPGDKEPCAHPNSRFCAPARQCPIMDPAWEAPEGVPIDAIIFGGRRPKGKIIMHDPFAMRPFFGYNFGHYLEHWLSMEGRKGAQLPRIFHVNWFRRDEAGHFLWPGFGENARVLDWICRRLEGEDSARETPIGLVPKEGALDLSGLRAIDTTQLFSLPKDFWEQEVRDIRSYLTEQVNQDLPKEVLAELEALERRVHKM

SEQ ID NO: 122 - DNA, 924 bp, Homo sapiens
  CDS (3)..(911)
ctaaatttccaaccttcttgttgaccggcattcctggcctagagtctgcccatgtctggatctccattcctttctgttgtttttatgccattgccctctctgggaacagcgtgatcctgtttgtcatcattacccagcagagtctccatgaacccatgtattatttcctcttcaggctatcagccactgatctggacttgactgtttcttcattgtcaacaacattaggtattctctggtttgaggcacgtgaaatcagtctatatagctgcattgtccagatgttttttcttcatggattcacttttatggaatctggagtgctggtggctacagcctttgaccgttatgcggccatctgtgaccctctgaggtacactaccattctcactaattccagaatcattcaaatgggtcttctgatgattacacgtgctatagtactaatattgccactacttttgctccttaagcctctctatttctgtagaatgaatgccctttctcactcctattgttaccatccagatgtgattcaattagcatgttcagacattcgggcaaatagcatctgtggattaactgatctcatcctgaccactggaatagatacaccatgcattgtcctgtcatatatcttaattattcactctgtcctcagaattgcctcccctgaagaatggcacaaggtcttcagcacctgtgtctcccatgtgggagcagttgctttcttctacatccacatgctgagcctgtccttggtgtatcgctatggtcggtcagcccccagagtagtccattcagtgatggctaatgtatacctgcttttaccccctgtgctcaaccccatcatcgacagtgtaaaaacaaaacaaatccgcaaggctatgctcagtctgctgcttacaaaatgaacagacatag

SEQ ID NO: 123 - protein, 303 aa, Homo sapiens
KFPTFLLTGIPGLESAHVWISIPFCCFYAIALSGNSVILFVIITQQSLHEPMYYFLFRLSATDLDLTVSSLSTTLGILWFEAREISLYSCIVQMFFLHGFTFMESGVLVATAFDRYAAICDPLRYTTILTNSRIIQMGLLMITRAIVLILPLLLLLKPLYFCRMNALSHSYCYHPDVIQLACSDIRANSICGLTDLILTTGIDTPCIVLSYILIIHSVLRIASPEEWHKVFSTCVSHVGAVAFFYIHMLSLSLVYRYGRSAPRVVHSVMANVYLLLPPVLNPIIDSVKTKQIRKAMLSLLLTK

SEQ ID NO: 124 - protein, 301 aa, Homo sapiens
MFSHLPFDCVLLLLLLLLTRSSEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTLQRDFTAAFPRMLTTRGHGPAETQTLGSLPDINLTQISTLANELRDSRLANDLRDSGATIRIGIYIGAGICAGLALALIFGALIFKWYSHSKEKIQNLSLISLANLPPSGLANAVAEGIRSEENIYTIEENVYEVEEPNEYYCYVSSRQQPSQPLGCRFAMP

SEQ ID NO: 125 - protein, 281 aa, Mus musculus
MFSGLTLNCVLLLLQLLLARSLENAYVFEVGKNAYLPCSYTLSTPGALVPMCWGKGFCPWSQCTNELLRTDERNVTYQKSSRYQLKGDLNKGDVSLIIKNVTLDDHGTYCCRIQFPGLMNDKKLELKLDIKAAKVTPAQTAHGDSTTASPRTLTTERNGSETQTLVTLHNNNGTKISTWADEIKDSGETIRTAIHIGVGVSAGLTLALIIGVLILKWYSCKKKKLSSLSLITLANLPPGGLANAGAVRIRSEENIYTIEENVYEVENSNEYYCYVNSQQPS

SEQ ID NO: 126 - protein, 305 aa, Mus musculus
MNQIQVFISGLILLLPGTVDSYVEVKGVVGHPVTLPCTYSTYRGITTTCWGRGQCPSSACQNTLIWTNGHRVTYQKSSRYNLKGHISEGDVSLTIENSVESDSGLYCCRVEIPGWFNDQKVTFSLQVKPEIPTRPPTRPTTTRPTATGRPTTISTRSTHVPTSIRVSTSTPPTSTHTWTHKPEPTTFCPHETTAEVTGIPSHTPTDWNGTVTSSGDTWSNHTEAIPPGKPQKNPTKGFYVGICIAALLLLLLVSTVAITRYILMKRKSASLSVVAFRVSKIEALQNAAVVHSRAEDNIYIVEDRP

SEQ ID NO: 127 - protein, 282 aa, Mus musculus
MNQIQVFISGLILLLPGAVDSYVEVKGVVGHPVTLPCTYSTYRGITTTCWGRGQCPSSACQNTLIWTNGHRVTYQKSSRYNLKGHISEGDVSLTIENSVESDSGLYCCRVEIPGWFNDQKVTFSLQVKPEIPTRPPRRPTTTRPTATGRPTTISTRSTHVPTSTRVSTSTPPTSTHTWTHKPDWNGTVTSSGDTWSNHTEAIPPGKPQKNPTKGFYVGICIAALLLLLLVSTVAITRYILMKRKSASLSVVAFRVSKIEALQNAAVVHSRAEDNIYIVEDRP

SEQ ID NO: 128 - protein, 294 aa, Rattus norvegicus
MVQLQVFISGLLLLLPGSVDSYEVVKGVVGHPVTIPCTYSTRGGITTTCWGRGQCPYSSCQNILIWTNGYQVTYRSSGRYNIKGRISEGDVSLTIENSVDSDSGLYCCRVEIPGWFNDQKMTFSLEVKPEIPTSPPTRPTTTRPTTTRPTTISTRSTHVPTSTRVSTSTPTPEQTQTHKPEITTFYAHETTAEVTETPSYTPADWNGTVTSSEEAWNNHTVRIPLRKPQRNPTKGFYVGMSVAALLLLLLASTVVVTRYIIIRKKMGSLSFVAFHVSKSRALQNAAIVHPRAED

SEQ ID NO: 129 - protein, 52 aa, Artificial Sequence
  Description of Artificial Sequence:  NGF domain consensus sequence
EPVSRRGELSVCDSVSVWVTNDKTTAVDIRGKEVTVLGEVNINNGPLKQYFF

SEQ ID NO: 130 - protein, 46 aa, Artificial Sequence
  Description of Artificial Sequence:  NGF domain consensus sequence
HWNSECKTTQTYVRALTMDNNKLVGWRFIRIDTACVCTLSRKTGRT

SEQ ID NO: 131 - protein, 637 aa, Homo Sapiens
MIQSDKGADPPDKKDMKLSTATNPQNGLSQILRLVLQELSLFYSRDVNGVCLLYDLLHSPWLQALLKIYDCLQEFKEKKLVPATPHAQVLSYEVVELLRETPTSPEIQELRQMLQAPHFKALLSAHDTIAQKDFEPLLPPLPDNIPESEEAMRIVCLVKNQQPLGATIKRHEMTGDILVARIIHGGLAERSGLLYAGDKLVEVNGVSVEGLDPEQVIHILAMSRGTIMFKVVPVSDPPVNSQQMVYVRAMTEYWPQEDPDIPCMDAGLPFQKGDILQIVDQNDALWWQARKISDPATCAGLVPSNHLLKRKQREFWWSQPYQPHTCLKSTLSISMEEEDDMKIDEKCVEADEETFESEELSEDKEEFVGYGQKFFIAGFRRSMRLCRRKSHLSPLHASVCCTGSCYSAVGAPYEEVVRYQRRPSDKYRLIVLMGPSGVGVNELRRQLIEFNPSHFQSAVPHTTRTKKSYEMNGREYHYVSKETFENLIYSHRMLEYGEYKGHLYGTSVDAVQTVLVEGKICVMDLEPQDIQGVRTHELKPYVIFIKPSNMRCMKQSRKNAKVITDYYVDMKFKDEDLQEMENLAQRMETQFGQFFDHVIVNDSLHDACAQLLSAIQKAQEEPQWVPATWISSDTESQ

SEQ ID NO: 132 - protein, 593 aa, Homo sapiens
MIQSDKGADPPDKKDMKLSTATNPQNGLSQILRLVLQELSLFYGRDVNGVCLLYDLLHSPWLQALLKIYDCLQEFKEKKLVPATPHAQVLSYEVVELLRETPTSPEIQELRQMLQAPHFKALLSAHDTIAQKDFEPLLPPLPDNIPESEEAMRIVCLVKNQQPLGATIKRHEMTGDILVARIIHGGLAERSGLLYAGDKLVEVNGVSVEGLDPEQVIHILAMSRGTIMFKVVPVSDPPVNSQQMDPDIPCMDAGLPFQKGDILQIVDQNDALWWQARKISDPATCAGLVPSNHLLKRKQREFWWSQPYQPHTCLKSTLYKEEFVGYGQKFFIAGFRRSMRLCRRKSHLSPLHASVCCTGSCYSAVGAPYEEVVRYQRRPSDKYRLIVLMGPSGVGVNELRRQLIEFNPSHFQSAVPHTTRTKKSYEMNGREYHYVSKETFENLIYSHRMLEYGEYKGHLYGTSVDAVQTVLVEGKICVMDLEPQDIQGVRTHELKPYVIFIKPSNMRCMKQSRKNAKVITDYYVDMKFKDEDLQEMENLAQRMETQFGQFFDHVIVNDSLHDACAQLLSAIQKAQEEPQWVPATWISSDTESQ

SEQ ID NO: 133 - protein, 485 aa, Mus musculus
MRIVCLVKNQQPLGATIKRHEITGDILVARVIHGGLVERSGLLYAGDKLVEVNGVSVEGLDPEQVIHILAMSCGTIMFKVIPVSAPPVSSQKMGYVRAMIDYWPQEDPDIPCMDAGLPFLKGDILQIVDQNDALWWQARKISDLTICAGLIPSNHLLKRKQREFWWSQPYQPHTCLKSTRALSMEEEDSMKIDEKCVEADEETFESEELAEAKDEFVGDGQKFFIAGFRRSMRLCRRKSHFSQLHASLCCSCSCYSAVGAPYEEVVRYQRQPADKHRLIVLVGPSGVGVNELRRQLIGCNPSCFQSAVPHTTRSPKSYEMDGREYHYVSRETFESLMYGHKMLEYGEYKGHLYGTSVNAVHAVLDEGKICIMDLEPQDIQLARTRDLKPCVIFIKPPNTSSMRHSRKNAKITTDYYVDMKFKDEDLQEMEELAQKMESQFGQFFDHVIVNDNLQDACGQLLSAIQRAQEELQWVPEAWVSPDTES

SEQ ID NO: 134 - protein, 479 aa, Mus musculus
MRIVCLVKNQQPLGATIKRHEITGDILVARVIHGGLVERSGLLYAGDKLVEVNGVSVEGLDPEQVIHILAMSCGTIMFKVIPVSAPPVSSQKMGYVRAMIDYWPQEDPDIPCMDAGLPFLKGDILQIVDQNDALWWQARKISDLTICAGLIPSNHLLKRKQREFWWSQPYQPHTCLKSTREDSMKIDEKCVEADEETFESEELAEAKDEFVGDGQKFFIAGFRRSMRLCRRKSHFSQLHASLCCSCSCYSAVGAPYEEVVRYQRQPADKHRLIVLVGPSGVGVNELRRQLIGCNPSCFQSAVPHTTRSPKSYEMDGREYHYVSRETFESLMYGHKMLEYGEYKGHLYGTSVNAVHAVLDEGKICIMDLEPQDIQLARTRDLKPCVIFIKPPNTSSMRHSRKNAKITTDYYVDMKFKDEDLQEMEELAQKMESQFGQFFDHVIVNDNLQDACGQLLSAIQRAQEELQWVPEAWVSPDTES

SEQ ID NO: 135 - protein, 441 aa, Rattus norvegicus
MRTVCLVKNQQPLGATIKRHEITGDILVARVIHGGLVERNGLLYAGDKLVEVNGVPVEGLDPEQVIHILAMSCGTIMFKVIPVSAPPVSSQTTVYVRAMIDYWPQEDPDIPCMDAGLPFLKGDILQIVDQSDALWWQARKISDIAICAGLIPSNHLLKRKQREFWWSQPYQPHTCLKSTRSKEEFVGDGQQFFIAGFRQQHANMRCTCSCYSAVGAPYEEVVRYQRQPADKHRLIVLVGPSGVGVNELRRQLIGCNPSCFQSAVPHTTRSPKSYEMDGREYHYVSRETFESLMYGHRMLEFGEYKGHLYGTSVNAVLAVLDEGKICVMDLEPQDIQLARTRELKPYVIFIKPPSMSSMRHSRRNAKIITDYFVDMKFKDEDLQEMEELAQKMESQFGQFFDHVIVNDNLQDARAQLLSAIQKAEEELQWVPEAWVSPGAES

SEQ ID NO: 136 - protein, 108 aa, Artificial Sequence
  Description of Artificial Sequence:GK, Guanylate kinase domain consensus sequence
TRPVPRPGEVDGKDYHFVSSREEMEKDIAANEFLEYGEFQGNYYGTSLETVRQVAKQGKICILDVEPQGVKRLRTAELSNPIVVFIAPPSLQELEKRLEGRNKESEES

SEQ ID NO: 137 - protein, 791 aa, Homo sapiens
KRGYTPLHAAASNGQINVVKHLLNLGVEIDEINVYGNTALHIACYNGQDAVVNELIDYGANVNQPNNNGFTPLHFAAASTHGALCLELLVNNGADVNIQSKDGKSPLHMTAVHGRFTRSQTLIQNGGEIDCVDKDGNTPLHVAARYGHELLINTLITSGADTAKCGIHSMFPLHLAALNAHSDCCRKLLSSGQKYSIVSLFSNEHVLSAGFEIDTPDKFGRTCLHAAAAGGNVECIKLLQSSGADFHKKDKCGRTPLHYAAANCHFHCIETLVTTGANVNETDDWGRTALHYAAASDMDRNKTILGNAHDNSEELERARELKEKEATLCLEFLLQNDANPSIRDKEGYNSIHYAAAYGHRQCLELLLERTNSGFEESDSGATKSPLHLAAYNGHHQALEVLLQSLVDLDIRDEKGRTALDLAAFKGHTECVEALINQGASIFVKDNVTKRTPLHASVINGHTLCLRLLLEIADNPEAVDVKDAKGQTPLMLAVAYGHIDAVSLLLEKEANVDTVDILGCTALHRGIMTGHEECVQMLLEQEVSILCKDSRGRTPLHYAAARGHATWLSELLQMALSEEDCCFKDNQGYTPLHWACYNGNENCIEVLLEQKCFRKFIGNPFTPLHCAIINDHGNCASLLLGAIDSSIVSCRDDKGRTPLHAAAFADHVECLQLLLRHSAPVNAVDNSGKTALMMAAENGQAGAVDILVNSAQADLTVKDKDLNTPLHLACSKGHEKCALLILDKIQDESLINEKNNALQTPLHVAARNGLKVVVEELLAKGACVLAVDENGC

SEQ ID NO: 138 - protein, 1059 aa, Homo sapiens
GAEATAMAFLKLRDQPSLVQAIFNGDPDEVRALIFKKEDVNFQDNEKRTPLHAAAYLGDAEIIELLILSGARVNAKDSKWLTPLHRAVASCSEEAVQVLLKHSADVNARDKNWQTPLHIAAANKAVKCAEALVPLLSNVNVSDRAGRTALHHAAFSGHGEMVKLLLSRGANINAFDKKDRRAIHWAAYMGHIEVVKLLVSHGAEVTCKDKKSYTPLHAAASSGMISVVKYLLDLGVDMNEPNAYGNTPLHVACYNGQDVVVNELIDCGAIVNQKNEKGFTPLHFAAASTHGALCLELLVGNGADVNMKSKDGKTPLHMTALHGRFSRSQTIIQSGAVIDCEDKNGNTPLHIAARYGHELLINTLITSGADTAKRGIHGMFPLHLAALSGFSDCCRKLLSSGFDIDTPDDFGRTCLHAAAAGGNLECLNLLLNTGADFNKKDKFGRSPLHYAAANCNYQCLFALVGSGASVNDLDERGCTPLHYAATSDTDGKCLEYLLRNDANPGIRDKQGYNAVHYSAAYGHRLCLQLIASETPLDVLMETSGTDMLSDSDNRATISPLHLAAYHGHHQALEVLVQSLLDLDVRNSSGRTPLDLAAFKGHVECVDVLINQGASILVKDYILKRTPIHAAATNGHSECLRLLIGNAEPQNAVDIQDGNGQTPLMLSVLNGHTDCVYSLLNKGANVDAKDKWGRTALHRGAVTGHEECVDALLQHGAKCLLRDSRGRTPIHLSAACGHIGVLGALLQSAASMDANPATADNHGYTALHWACYNGHETCVELLLEQEVFQKTEGNAFSPLHCAVINDNEGAAEMLIDTLGASIVNATDSKGRTPLHAAAFTDHVECLQLLLSHNAQVNSVDSTGKTPLMMAAENGQTNTVEMLVSSASAELTLQDNSKNTALHLACSKGHETSALLILEKITDRNLINATNAALQTPLHVAARNGLTMVVQELLGKGASVLAVDENGYTPALACAPNKDVADCLALILATMMPVSSSSPLSSLTFNAINRYTNTSKTVSFEALPIMRNEPSSYCSFNNIGGEQEYLYTDVDELNDSDSETY

SEQ ID NO: 139 - protein, 1159 aa, Drosophila melanogaster
MVTENGAQGDGNTSFLRAARAGNLERVLEHLKNNIDINTSNANGLNALHLASKDGHIHVVSELLRRGAIVDSATKKGNTALHIASLAGQEEVVKLLLEHNASVNVQSQNGFTPLYMAAQENHDAVVRLLLSNGANQSLATEDGFTPLAVAMQQGHDKVVAVLLESDTRGKVRLPALHIAAKKDDVKAATLLLDNDHNPDVTSKSGFTPLHIASHYGNQNIANLLIQKGADVNYSAKHNISPLHVAAKWGKTNMVSLLLEKGGNIEAKTRDGLTPLHCAARSGHEQVVDMLLERGAPISAKTKNGLAPLHMAAQGEHVDAARILLYHRAPVDEVTVDYLTALHVAAHCGHVRVAKLLLDRNADANARALNGFTPLHIACKKNRLKVVELLLRHGASISATTESGLTPLHVAAFMGCMNIVIYLLQHDASPDVPTVRGETPLHLAARANQTDIIRILLRNGAQVDARAREQQTPLHIASRLGNVDIVMLLLQHGAQVDATTKDMYTALHIAAKEGQDEVAAVLIENGAALDAATKKGFTPLHLTAKYGHIKVAQLLLQKEADVDAQGKNGVTPLHVACHYNNQQVALLLLEKGASPHATAKNGHTPLHIAARKNQMDIATTLLEYGALANAESKAGFTPLHLSSQEGHAEISNLLIEHKAAVNHPAKNGLTPMHLCAQEDNVNVAEILEKNGANIDMATKAGYTPLHVASHFGQANMVRFLLQNGANVDAATSIGYTPLHQTAQQGHCHIVNLLLEHKANANAQTVNGQTPLHIARKLGYISVLDSLKTITKEDETAAAPSQAEEKYRVVAPEAMHESFMSDSEEEGGEDNMLSDQPYRYLTVDEMKSLGDDSLPIDVTRDERMDSNRMTQSAEYASGVPPTIGEEVISPHKTQVYGSSPKATVDGVYIANGSGHDEPPHVGRKLSWKSFLVSFLVDARGGAMRGCRHSGVRMIIPSRSTCQPTRVTCRYVKPQRTMHPPQLMEGEALASRVLELGPCSTKFIGPVVMEVPHFASLRGKEREIIILRSDNGETWREHTIDNSEEIIHDVLQQCFEPEEIAQLEEQAGNHVCRFVTYDFPQYFAVVSRIRQEVHAIGPEGGMVSSTVVPQVQAVFPQGALTKKIKVGLQVNLFKPRKGVAPEKLRKISVNHVPKKKRFSLIW

SEQ ID NO: 140 - protein, 1765 aa, Mus musculus
MSEEPKEKPAKPAHRKRKGKKSDANASYLRAARAGHLEKALDYIKNGVDVNICNQNGLNALHLASKEGHVEVVSELLQREANVDAATKKGNTALHIASLAGQAEVVKVLVTNGANVNAQSQNGFTPLYMAAQENHLEVVRFLLDNGASQSLATEDGFTPLAVALQQGHDQVVSLLLENDTKGKVRLPALHIAARKDDTKAAALLLQNDTNADVESKSGFTPLHIAAHYGNINVATLLLNRAAAVDFTARNDITPLHVASKRGNANMVKLLLDRGAKIDAKTRDGLTPLHCGARSGHEQVVEMLLDRSAPILSKTKNGLSPLHMATQGDHLNCVQLLLQHNVPVDDVTNDYLTALHVAAHCGHYKVAKVLLDKKASPNAKALNGFTPLHIACKKNRIRVMELLLKHGASIQAVTESGLTPIHVAAFMGHVNIVSQLMHHGASPNTTNVRGETALHMAARSGQAEVVRYLVQDGAQVEAKAKDDQTPLHISARLGKADIVQQLLQQGASPNAATTSGYTPLHLAAREGHEDVAAFLLDHGASLSITTKKGFTPLHVAAKYGKLEVASLLLQKSASPDAAGKSGLTPLHVAAHYDNQKVALLLLDQGASPHAAAKNGYTPLHIAAKKNQMDIATSLLEYGADANAVTRQGIASVHLAAQEGHVDMVSLLLSRNANVNLSNKSGLTPLHLAAQEDRVNVAEVLVNQGAHVDAQTKMGYTPLHVGCHYGNIKIVNFLLQHSAKVNAKTKNGYTALHQAAQQGHTHIINVLLQNNASPNELTVNGNTALAIARRLGYISVVDTLKVVTEEIMTTTTITEKHKMNVPETMNEVLDMSDDEVRKASAPEKLSDGEYISDGEEGDKCTWFKIPKVQEVLVKSEDAITGDTDKYLGPQDLKELGDDSLPAEGYVGFSLGARSASLRSFSSDRSYTLNRSSYARDSMMIEELLVPSKEQHLTFTREFDSDSLRHYSWAADTLDNVNLVSSPVHSGFLVSFMVDARGGSMRGSRHHGMRIIIPPRKCTAPTRITCRLVKRHKLANPPPMVEGEGLASRLVEMGPAGAQFLGPVIVEIPHFGSMRGKERELIVLRSENGETWKEHQFDSKNEDLAELLNGMDEELDSPEELGTKRICRIITKDFPQYFAVVSRIKQESNQIGPEGGILSSTTVPLVQASFPEGALTKRIRVGLQAQPVPEETVKKILGNKATFSPIVTVEPRRRKFHKPITMTIPVPPPSGEGVSNGYKGDATPNLRLLCSITGGTSPAQWEDITGTTPLTFIKDCVSFTTNVSARFWLADCHQVLETVGLASQLYRELICVPYMAKFVVFAKTNDPVESSLRCFCMTDDRVDKTLEQQENFEEVARSKDIEVLEGKPIYVDCYGNLAPLTKGGQQLVFNFYSFKENRLPFSIKIRDTSQEPCGRLSFLKEPKTTKGLPQTAVCNLNITLPAHKKAEKADRRQSFASLALRKRYSYLTEPSMSPQSPCERTDIRMAIVADHLGLSWTELARELNFSVDEINQIRVENPNSLISQSFMLLKKWVTRDGKNATTDALTSVLTKINRIDIVTLLEGPIFDYGNISGTRSFADENNVFHDPVDGWQNETPSGSLESPAQARRLTGGLLDRLDDSSDQARDSITSYLTGEPGKIEANGNHTAEVIPEAKAKPYFPESQNDIGKQSIKENLKPKTHGCGRTEEPVSPLTAYQKSLEETSKLVIEDAPKPCVPVGMKKMTRTTADGKARLNLQEEEGSTRSEPKQGEGYKVKTKKEIRNVEKKTH

SEQ ID NO: 141 - protein, 1940 aa, Mus musculus
MSEEPKEKPAKPAHRKRKGKKSDANASYLRAARAGHLEKALDYIKNGVDVNICNQNGLNALHLASKEGHVEVVSELLQREANVDAATKKGNTALHIASLAGQAEVVKVLVTNGANVNAQSQNGFTPLYMAAQENHLEVVRFLLDNGASQSLATEDGFTPLAVALQQGHDQVVSLLLENDTKGKVRLPALHIAARKDDTKAAALLLQNDTNADVESKSGFTPLHIAAHYGNINVATLLLNRAAAVDFTARNDITPLHVASKRGNANMVKLLLDRGAKIDAKTRDGLTPLHCGARSGHEQVVEMLLDRSAPILSKTKNGLSPLHMATQGDHLNCVQLLLQHNVPVDDVTNDYLTALHVAAHCGHYKVAKVLLDKKASPNAKALNGFTPLHIACKKNRIRVMELLLKHGASIQAVTESGLTPIHVAAFMGHVNIVSQLMHHGASPNTTNVRGETALHMAARSGQAEVVRYLVQDGAQVEAKAKDDQTPLHISARLGKADIVQQLLQQGASPNAATTSGYTPLHLAAREGHEDVAAFLLDHGASLSITTKKGFTPLHVAAKYGKLEVASLLLQKSASPDAAGKSGLTPLHVAAHYDNQKVALLLLDQGASPHAAAKNGYTPLHIAAKKNQMDIATSLLEYGADANAVTRQGIASVHLAAQEGHVDMVSLLLSRNANVNLSNKSGLTPLHLAAQEDRVNVAEVLVNQGAHVDAQTKMGYTPLHVGCHYGNIKIVNFLLQHSAKVNAKTKNGYTALHQAAQQGHTHIINVLLQNNASPNELTVNGNTALAIARRLGYISVVDTLKVVTEEIMTTTTITEKHKMNVPETMNEVLDMSDDEGDKCTWFKIPKVQEVLVKSEDAITGDTDKYLGPQDLKELGDDSLPAEGYVGFSLGARSASLRSFSSDRSYTLNRSSYARDSMMIEELLVPSKEQHLTFTREFDSDSLRHYSWAADTLDNVNLVSSPVHSGFLVSFMVDARGGSMRGSRHHGMRIIIPPRKCTAPTRITCRLVKRHKLANPPPMVEGEGLASRLVEMGPAGAQFLGPVIVEIPHFGSMRGKERELIVLRSENGETWKEHQFDSKNEDLAELLNGMDEELDSPEELGTKRICRIITKDFPQYFAVVSRIKQESNQIGPEGGILSSTTVPLVQASFPEGALTKRIRVGLQAQPVPEETVKKILGNKATFSPIVTVEPRRRKFHKPITMTIPVPPPSGEGVSNGYKGDATPNLRLLCSITGGTSPAQWEDITGTTPLTFIKDCVSFTTNVSARFWLADCHQVLETVGLASQLYRELICVPYMAKFVVFAKTNDPVESSLRCFCMTDDRVDKTLEQQENFEEVARSKDIEVLEGKPIYVDCYGNLAPLTKGGQQLVFNFYSFKENRLPFSIKIRDTSQEPCGRLSFLKEPKTTKGLPQTAVCNLNITLPAHKKAEKADRRQSFASLALRKRYSYLTEPSMSPQSPCERTDIRMAIVADHLGLSWTELARELNFSVDEINQIRVENPNSLISQSFMLLKKWVTRDGKNATTDALTSVLTKINRIDIVTLLEGPIFDYGNISGTRSFADENNVFHDPVDGHPSFQVELETPMGLYWTPPNPFQQDDHFSDISSIESPFRTPSRLSDGLVPSQGNIEHPTGGPPVVTAEDTSLEDSKMDDSVTVTDPADPLDVDESQLKDLCQSECAQCWASVPGIPNDGRQAEPLRPQTRKVGMSSEQQEKGKSGPDEEVTEDKVKSLFEDIQLEEVEAEEMTEDQGQAMLNRVQRAELAMSSLAGWQNETPSGSLESPAQARRLTGGLLDRLDDSSDQARDSITSYLTGEPGKIEANGNHTAEVIPEAKAKPYFPESQNDIGKQSIKENLKPKTHGCGRTEEPVSPLTAYQKSLEETSKLVIEDAPKPCVPVGMKKMTRTTADGKARLNLQEEEGSTRSEPKQGEGYKVKTKKEIRNVEKKTH

SEQ ID NO: 142 - protein, 33 aa, Artificial Sequence
  Description of Artificial Sequence:ANK domain consensus sequence
DGRTPLHLAARNGHLEVVKLLLEAGADVNARDK

SEQ ID NO: 143 - protein, 33 aa, Artificial Sequence; identical to SEQ ID NO: 142
  Description of Artificial Sequence:ANK domain consensus sequence

SEQ ID NO: 144 - protein, 1637 aa, Drosophila melanogaster
MEYESSEISDITTGSCKKRLTFLKCILSDTTSDQKWAAEFGEDTEGHQFSLDYLLDTFIVLYDECSNSSLRREKGVSDFLKLSKPFVHIVRKLRLSRDDFDILKIIGRGAFGEVCVVQMISTEKVYAMKILNKWEMLKRAETACFREERDVLVFGDRQWITNLHYAFQDNINLYLVMDYYCGGDLLTLLSKFEDKLPEDMAKFYITEMILAINSIHQIRYVHRDIKPDNVLLDKRGHVRLADFGSCLRLDKDGTVQSNVAVGTPDYISPEILRAMEDGKGRYGTECDWWSLGVCMYEMLYGETPFYAESLVETYGKIMNHQNCFNLPSQETLNYKVSETSQDLLCKLICIPENRLGQNGIQDFMDHPWFVGIDWKNIRQGPAPYVPEVSSPTDTSNFDVDDNDVRLTDSIPPSANPAFSGFHLPFIGFTFSLTSSSTLDSKKNQSSGFGDDTLDTISSPQLAILPSNNSETPVDSVQLKALNDQLAALKQEKAELSKQHNEVFERLKTQDSELQDAISQRNIAMMEYSEVTEKLSELRNQKQKLSRQVRDKEEELDGAMQKNDSLRNELRKSDKTRRELELHIEDAVIEAAKEKKLREHAEDCCRQLQMELRKGSSSVETTMPLSISSEMSSYEIERLELQFSEKLSHQQTRHNMELEALREQFSELENANLALTKELQQTQERLKYTQMESITDSAETLLELKKQHDLEKSSWFEEKQRLSSEVNLKSKSLKELQAEDDEIFKELRMKREAITLWERQMAEIIQWVSDEKDARGYLQALATKMTEELEYLKHVGTFNNNGVDNKNWRNRRSQKLDKMELLNLQSALQREIQAKNMISDELSQTRSDLISTQKEVRDYKKRYDSILHDFQKKETELRDLQKGGLEYSESFLNKSTHHGLSSAFFRDMSKNSEIIDSAESFGNESGDNFTPNFFQSGNSGMLFNYEPKYAGKNNKDHSSMKEASVSDLSREESDQLVKESQKKVPGNTAIHQFLVRTFSSPTKCNHCTSLMVGLTRQGVVCEICGFACHTICCQKVPTTCPVPMDQTKRPLGIDPTRGIGTAYEGYVKVPKSGVIKRGWIRQFVVVCDFKLFLYDISPDRCALPSVSVSQVLDMRDPEFSVGSVRESDVIHAAKKDVPCIFKIKTALIDGGLSLNTLMLADNESEKSKWVIALGELHRILKRNSLPNTAIFKVNEILDNTLSLIRNALCSVIIYPNQILLGTEDGLFYINLDQYEIARIGESKKILQLWYIEEEQILVILCGKQRNLRLLPIRALEASDVEWIKVVESKNCISACTGIIRRFPNIVYSFIIALKRPNNHTQIVVYEINRTRTRHQKTCEFTIGYMAQHLQILSDMRLVVAHQSGFTAYFLRGEATAMSLVHPENQLCAFLNYSGVDAVRVIEILCPSGGNFGEYLLVFQTLAIYVDLQGRKSRDREIMYPAFPTYITFCDGHLLVFSDTHLDIFNTQTAEWVQSIGLKQSLPLNNLGNVVLSSVNDTPLIVYLSNIHTKGLLQYRDGNRKGLPSIKRRFSIREINKTIKSDRRSKMISAPTNFNHISHMGPGDGIQNQRLLDLPTTLETADQACSPIIHSLSCIPQSRKSNFLEQVDANSDDYGNDNIISRTPSPMASSFMDGLSNND

SEQ ID NO: 145 - protein, 1613 aa, Drosophila melanogaster
MYSKRHHKRSKWAAEFDEDTEGHQFSLDYLLDTFIVLYDECSNSSLRREKGVSDFLKLSKPFVHIVRKLRLSRDDFDILKIIGRGAFGEVCVVQMISTEKVYAMKILNKWEMLKRAETACFREERDVLVFGDRQWITNLHYAFQDNINLYLVMDYYCGGDLLTLLSKFEDKLPEDMAKFYITEMILAINSIHQIRYVHRDIKPDNVLLDKRGHVRLADFGSCLRLDKDGTVQSNVAVGTPDYISPEILRAMEDGKGRYGTECDWWSLGVCMYEMLYGETPFYAESLVETYGKIMNHQNCFNLPSQETLNYKVSETSQDLLCKLICIPENRLGQNGIQDFMDHPWFVGIDWKNIRQGPAPYVPEVSSPTDTSNFDVDDNDVRLTDSIPPSANPAFSGFHLPFIGFTFSLTSSSTLDSKKNQSSGFGDDTLDTISSPQLAILPSNNSETPVDSVQLKALNDQLAALKQEKAELSKQHNEVFERLKTQDSELQDAISQRNIAMMEYSEVTEKLSELRNQKQKLSRQVRDKEEELDGAMQKNDSLRNELRKSDKTRRELELHIEDAVIEAAKEKKLREHAEDCCRQLQMELRKGSSSVETTMPLSISSEMSSYEIERLELQFSEKLSHQQTRHNMELEALREQFSELENANLALTKELQQTQERLKYTQMESITDSAETLLELKKQHDLEKSSWFEEKQRLSSEVNLKSKSLKELQAEDDEIFKELRMKREAITLWERQMAEIIQWVSDEKDARGYLQALATKMTEELEYLKHVGTFNNNGVDNKNWRNRRSQKLDKMELLNLQSALQREIQAKNMISDELSQTRSDLISTQKEVRDYKKRYDSILHDFQKKETELRDFEKGGLEYSESFLNKSTHHGLSSAFFRDMSKNSEIIDSAESFGNESGDNFTPNFFQSGNSGMLFNYEPKYAGKNNKDHSSMKEASVSDLSREESDQLVKESQKKVPGNTAIHQFLVRTFSSPTKCNHCTSLMVGLTRQGVVCEICGFACHTICCQKVPTTCPVPMDQTKRPLGIDPTRGIGTAYEGYVKVPKSGVIKRGWIRQFVVVCDFKLFLYDISPDRCALPSVSVSQVLDMRDPEFSVGSVRESDVIHAAKKDVPCIFKIKTALIDGGLSLNTLMLADNESEKSKWVIALGELHRILKRNSLPNTAIFKVNEILDNTLSLIRNALCSVIIYPNQILLGTEDGLFYINLDQYEIARIGESKKILQLWYIEEEQILVILCGKQRNLRLLPIRALEASDVEWIKVVESKNCISACTGIIRGFPNIVYSFIIALKRPNNHTQIVVYEINRTRTRHQKTCEFTIGYMAQHLQILSDMRLVVAHQSGFTAYFLRGEATAMSLVHPENQLCAFLNYSGVDAVRVIEILCPSGGNFGEYLLVFQTLAIYVDLQGRKSRDREIMYPAFPTYITFCDGHLLVFSDTHLDIFNTQTAEWVQSIGLKQSLPLNNLGNVVLSSVNDTPLIVYLSNIHTKGLLQYRDGNRKGLPSIKRRFSIREINKTIKSDRRSKMISAPTNFNHISHMGPGDGIQNQRLLDLPTTLETADQACSPIIHSLSCIPQSRKSNFLEQVDANSDDYGNDNIISRTPSPMASSFMDGLSNND

SEQ ID NO: 146 - protein, 1590 aa, Caenorhabditis elegans
MAEPPPDDSAPVRLKTLENIYMDGPSKKPEALSFETLIDSLICLYDECCNSTLRKEKCIAEFVESVKTVISKAKKLRLSRDDFEVLKVIGKGAFGEVAVVRMRGVGEIYAMKILNKWEMVKRAETACFREERDVLVYGDRRWITNLHYAFQDEKNLYFVMDYYIGGDMLTLLSKFVDHIPESMAKFYIAEMVLAIDSLHRLGYVHRDVKPDNVLLDMQGHIRLADFGSCLRILADGSVASNVAVGTPDYISPEILRAMEDGRGRYGKECDWWSLGICMYEMLYGTTPFYSERLVDTYGKIMSHQDMLDFPDDEIDWVVSEEAKDLIRQLICSSDVRFGRNGLSDFQLHPFFEGIDWNTIRDSNPPYVPEVSSPEDTSNFDVDVCEDDFTPCETQPPRVLAAFTGNHLPFVGFSYTHGSLLSDARSLTDEIRAIAQRCQGDAELMEKSVDGFMVELENEKAELVQKLKEAQTIIAQHVAENPRSEEDRNYESTIAQLKDEIQILNKRLEDEALAQQQQKPKDEIVAESEKKLKELKERNKQLVMEKSEIQRELDNINDHLDQVLVEKATVVQQRDDMQAELADVGDSLLTEKDSVKRLQDEAEKAKKQVADFEEKLKEIETEKIALIKKQEEVTIEARKSVETDDHLSEEVVAAKNTIASLQATNEERETEIKKLKQRMDEERASHTAQSEQEMKQLEAHYERAQKMLQDNVEQMNVENRGLRDEIEKLSQQMAALPRGGLNEQQLHEIFNWVSEEKATREEMENLTRKITGEVESLKNNSPLTTSNYIQNTPSGWGSRRMNNVARKDGLDLQRQLQAEIDAKLKLKAELKNSQEQYLTSAARLDDTEKRMASLMREVAMLKQQKNIENSSDSAFSSTMGRGDLMISMNNDYEMSNSSLMRQEMISRQSTPSYENAILLHDHQVPKRVDDLRYKQKPMKTASGIFSPVSISAMERGHNFERMKIKTPTKCGHCTSILIGLDRQGLFCQSCQYACHVSCAERVSQSCPVPEEERRPLGIDPTRGVGTAYEGLVKTPRAGGVRKGWQTAYVVVCDFKLYLYDCTVDRQNKMQDVKNEIRLVLDMRDPDFTVCGVSEADVIHAQKGDIPKIFRVTTTQILNSSSEYSSSSKFYTLFMAETEEEKRKWVVALSELKTLLRRSKLADRKAFLVKEVFDVTTLPSIRVAQCCAIIDRSKIVIGFSDHGLYCIEISRQLLIPVGGEKENKQRCVETVEYDEAEQLLMMIVGPAKDRHVRIVPSAALDGRDLKWIKVNDTKGCHLLAVGTNNPGGRAGFFAVAFKKSVTIFQIDRSEKRHKKWKDLAMPGTPQSIAIFNGRLYVGFSHSFRSWSLVGVDSSPVGSGDASGAVLQHISLVNMEDTSLQFLNQQTSYEAKLIVNVPGSPDEYLLVFNMIGLYVNEMGRRSRLPEVMFPTQAKYFAYHEPYLCVFSENEVDIFNVTLAEWVQTINLRSAKPLSGDGILSTCLCNDSPIFVLLQNVLQDQDSIEVPVNLASGSTDGRKVTRRKFTFRTIGKDDRSASERRSHIQISTPSDFMHIVHMGPAPVMELQQNFIDLQSNHSHTSSDKDSLNRSVNND

SEQ ID NO: 147 - protein, 1732 aa, Rattus norvegicus
MSGEVRLRQLEQFILDGPAQTNGQCFSVETLLDILICLYDECNNSPLRREKNILEYLEWAKPFTSKVKQMRLHREDFEILKVIGRGAFGEVAVVKLKNADKVFAMKILNKWEMLKRAETACFREERDVLVNGDSKWITTLHYAFQDDNNLYLVMDYYVGGDLLTLLSKFEDRLPEEMARFYLAEMVIAIDSVHQLHYVHRDIKPDNILMDMNGHIRLADFGSCLKLMEDGTVQSSVAVGTPDYISPEILQAMEDGKGRYGPECDWWSLGVCMYEMLYGETPFYAESLVETYGKIMNHKERFQFPTQVTDVSENAKDLIRRLICSREHRLGQNGIEDFKKHPFFSGIDWDNIRNCEAPYIPEVSSPTDTSNFDVDDDCLKNSETMPPPTHTAFSGHHLPFVGFTYTSSCVLSDRSCLRVTAGPTSLDLDVNVQRTLDNNLATEAYERRIKRLEQEKLELTRKLQESTQTVQALQYSTVDGPLTASKDLEIKSLKEEIEKLRKQVAEVNHLEQQLEEANSVRRELDDAFRQIKAFEKQIKTLQQEREELNKELVQASERLKNQSKELKDAHCQRKLAMQEFMEINERLTELHTQKQKLARHVRDKEEEVDLVMQKAESLRQELRRAERAKKELEVHTEALIAEASKDRKLREQSRHYSKQLENELEGLKQKQISYSPGICSIEHQQEITKLKTDLEKKSIFYEEEISKREGIHASEIKNLKKELHDSEGQQLALNKEIMVLKDKLEKTRRESQSEREEFENEFKQQYEREKVLLTEENKKLTSELDKLTSLYESLSLRNQHLEEEVKDLADKKESVAHWEAQITEIIQWVSDEKDARGYLQALASKMTEELEALRNSSLGTRATDMPWKMRRFAKLDMSARLELQSALDAEIRAKQAIQEELNKVKASNIITECKLKDSEKKNLELLSEIEQLIKDTEELRSEKGVEHRDSQHSFLAFLNTPTDALDQFERSPSCTPAGKGRRIADSAPLPVHTPTLRKKGCPASAGFPPKRKTHQFFVKSFTAPTKCHQCTSLMVGLIRQGCSCEVCGFSCHITCVNKAPTTCPVPPEQTKGPLGIDPQKGVGTAYEGHVRIPKPAGVKKGWQRALAVVCDFKLFLYDIAEGKASQPSSVISQVIDMRDEEFSVSSVLASDVIHASRKDIPCIFRVTASQLSAPSDKCSILMLADSETERSKWVGVLSELHKVLKKNKFRDRSVYVPKEAYDSTLPLIKTTQAAAIIDHERVALGNEEGLFVVHVTKDEIIRVGDNKKIHQIELIPSDQLVAVISGRNRHVRLFPMSALDGRETDFYKLAETKGCQTIAAGKVRHGALSCLCVAMKRQVLCYELFQSKTRHRKFKEIQVPCNVQWMAIFSEHLCVGFQSGFLRYPLNGEGSPCNMLHSNDHTLAFITHQPMDAICAVEISNKEYLLCFSSIGIYTDCQGRRSRQQELMWPANPSSCCYNAPYLSIYSENAVDIFDVNSMEWIQTLPLKKVRPLNTEGSLNLLGLETIRLIYFKNKMAEGDELVVPETSDNSRKQMVRNINNKRRYSFRVPEEERMQQRREMLRDPEMRNKLISNPTNFNHIAHMGPGDGIQILKDLPMNPRPQESRTVFSGSVSIPSITKSRPEPGRSMSASSGLSARSSAQNGSALKREFSGGSYNTKRQPMPSPSEGSLSSGGVDQGSDAPVRDYDGEDSDSPRHSTASNSSNLSSPPSPVSPRKTKSLSLESTDRGSWDP

SEQ ID NO: 148 - protein, 1663 aa, Rattus norvegicus
MSAKVRLKKLEQLLLDGPWRNESSLSVETLLDVLVCLYTECSHSALRRDKYVAEFLEWAKPFTQLVKDMQLHREDFEIIKVIGRGAFGEVAVVKMKNTERIYAMKILNKWEMLKRAETACFREERDVLVNGDCQWITALHYAFQDENYLYLVMDYYVGGDLLTLLSKFEDKLPEDMARFYIGEMVLAIDSIHQLHYVHRDIKPDNVLLDVNGHIRLADFGSCLKMNDDGTVQSSVAVGTPDYISPEILQAMEDGMGKYGPECDWWSLGVCMYEMLYGETPFYAESLVETYGKIMNHEERFQFPSHVTDVSEEAKDLIQRLICSRERRLGQNGIEDFKKHAFFEGLNWENIRNLEAPYIPDVSSPSDTSNFDVDDDVLRNIEILPPGSHTGFSGLHLPFIGFTFTTESCFSDRGSLKSMIQSNTLTKDEDVQRDLENSLQIEAYERRIRRLEQEKLELSRKLQESTQTVQSLHGSTRALGNSNRDKEIKRLNEELERMKSKMADSNRLERQLEDTVTLRQEHEDSTQRLKGLEKQYRLARQEKEELHKQLVEASERLKSQTKELKDAHQQRKRALQEFSELNERMAELRSQKQKVSRQLRDKEEEMEVAMQKIDSMRQDIRKSEKSRKELEARLEDAVAEASKERKLREHSESFSKQMERELETLKVKQGGRGPGATLEHQQEISKIRSELEKKVLFYEEELVRRERSHVLEVKNVKKEVHESESHQLALQKEVLMLKDKLEKSKRERHSEMEEAIGAMKDKYERERAMLFDENKKLTAENEKLCSFVDKLTAQNRQLEDELQDLASKKESVAHWEAQIAEIIQWVSDEKDARGYLQALASKMTEELETLRSSSLGSRTLDPLWKVRRSQKLDMSARLELQSALEAEIRAKQLVHEELRKVKDTSLAFESKLKESEAKNRELLEEMQSLKKRMEEKFRADTGLKLPDFQDPIFEYFNTAPLAHDLTFRTSSASDQETQASKLDLSPSVSVATSTEQQEDAARSQQRPSTVPLPNTQALAMAGPKPKAHQFSIKSFPSPTQCSHCTSLMVGLIRQGYACEVCAFSCHVSCKDSAPQVCPIPPEQSKRPLGVDVQRGIGTAYKGYVKVPKPTGVKKGWQRAYAVVCDCKLFLYDLPEGKSTQPGVIASQVLDLRDDEFAVSSVLASDVIHATRRDIPCIFRVTASLLGSPSKTSSLLILTENENEKRKWVGILEGLQAILHKNRLRSQVVHVAQEAYDSSLPLIKTVLAAAIVDGDRIAVGLEEGLYVIELTRDVIVRAADCKKVYQIELAPKEKLILLLCGRNHHVHLYPWTSFDGAEASNFDIKLPETKGCQLIATGTLRKSSSTCLFVAVKRLVLCYEIQRTKPFHRKFNEIVAPGHVQWMAMFKDRLCVGYPSGFSLLSIQGDGQPLDLVNPADPSLAFLSQQSFDALCAVELKSEEYLLCFSHMGLYVDPQGRRSRTQELMWPAAPVACSCSSSHVTVYSEYGVDVFDVRTMEWVQTIGLRRIRPLNSDGSLNLLGCEPPCLIYFKNKFSGTVLNVPDTSDNSKKQMLRTRSKRRFVFKVPEEERLQQRREMLRDPELRSKMISNPTNFNHVAHMGPGDGMQVLMDLPLSVRPQPRRKSRVLPQQASLGSLPSRNKPYVSWPSSGGSEPGVPVPLRSMSDP

SEQ ID NO: 149 - protein, 278 aa, Artificial Sequence
  Description of Artificial Sequence:PKINASE domain consensus sequence
YELLEKLGEGSFGKVYKAKHKTGKIVAVKILKKESLSLREIQILKRLSHPNIVRLLGVFEDTDDHLYLVMEYMEGGDLFDYLRRNGPLSEKEAKKIALQILRGLEYLHSNGIVHRDLKPENILLDENGTVKIADFGLARLLEKLTTFVGTPWYMMAPEVILEGRGYSSKVDVWSLGVILYELLTGGPLFPGADLPAFTGGDEVDQLIIFVLKLPFSDELPKTRIDPLEELFRIKKRRLPLPSNCSEELKDLLKKCLNKDPSKRPGSATAKEILNHPWF

SEQ ID NO: 150 - protein, 104 aa, Homo sapiens
MAKISSPTETVRCIQSLIAVFQKYAGKDGYNCNLSKTEFLSFMNTELAAFTKNQKDPGVLDRMKKLDVSSDGQLDFPKFLNLIGGLAVACHDSFLKAVPSQKWT

SEQ ID NO: 151 - protein, 102 aa, Homo sapiens
MAKISSPTETERCIESLIAVFQKYAGKDGYNRNLSKTEFLSFMNTELAAFTKNQKDPGVLDHMKKLDVSSDGQLDFPKFLNLIGGLAVACHDSFLKAVPSQK

SEQ ID NO: 152 - protein, 105 aa, Homo sapiens
MAKISSPTETERCIESLIAVFQKYAGKDGYNYTLSKTEFLSFMNTELAAFTKNQKDPGVLDRMMKKLDTNSDGQLDFSEFLNLIGGLAMACHDSFLKAVPSQKRT

SEQ ID NO: 153 - protein, 102 aa, Oryctolagus cuniculus
MSRPTETERCIESLIAVFQKYAGKDGHSVTLSKTEFLSFMNTELAAFTKNQKDPGVLDRMMKKLDLNSDGQLDFQEFLNLIGGLAVACHESFVKAAPPQKRF

SEQ ID NO: 154 - protein, 98 aa, Mus musculus
MPTETERCIESLIAVFQKYSGKDGNNTQLSKTEFLSFMNTELAAFTKNQKDPGVLDRMMKKLDLNCDGQLDFQEFLNLIGGLAIACHDSFIQTSQKRI

SEQ ID NO: 155 - protein, 44 aa, Artificial Sequence
  Description of Artificial Sequence: S100 domain consensus sequence
LEKAIETIINVFHQYSGREGDKDTLSKKELKELLEKELPNFLKN

SEQ ID NO: 156 - protein, 737 aa, Mus musculus
MWLLLHVILLTEVKDFALADSSMVAPLCPKGYFPCGNLTKCLPRAFHCDGVDDCGNGADEDNCGDTSGWTTIFGTVHGNVNKVTLTQECFLSQYPQHCYCRENELECVKADLKAVPKVSSNVTLLSLKKNKIHRLPVKVFSRYTELRKIYLQHNCITHISRRAFLGLHNLQILYLSHNCITSLRPGIFKDLHQLAWLILDDNPITRISQKSFMGLNSLFFLPMVGNRLEALPETLCAQMPQLNWVDLANNGIKYITNSTFLTCDSLTVLFLPRNQIGFVPEKTFSSLKNLGELDLSSNMITKLPVHLFSDLHLLQKLNLSSNPLLYVHKNQFGSLKQLQSLDLERIEIPNISTGMFQPMKNLSHIYLKTFRYCSYVPHVRICMPSTDGISSSEDLLANGILRVSVWVIAFITCVGNFLVIAVRSLIKAENTTHAMSIKILCCADCLMGVYLFSVGVFDIKYRGQYQKYALLWMESVPCRLLGFLATLSTEVSVLLLTFLTLEKFLVIVFPFSNLRLGKRQTAVALASIWVVGFLIAAVPFTREDYFGNFYGKNGVCFPLHYDQAEDFGSRGYSLGIFLGVNLLAFLVIVISYVTMFCSIHKTALQTAEVRSHIGKEVAVANRFFFIVFSDAICWIPVFVVKILSLLQVEIPGTITSWIVVFFLPVNSALNPILYTLTTSFFKDKLKQLLHKHRRKPIFKVKKKSLSASIVWTDESSLKLGVLSKIALGDSIMKPVSP

SEQ ID NO: 157 - protein, 757 aa, Homo sapiens
MTSGSVFFYILIFGKYFSHGGGQDVKCSLGYFPCGNITKCLPQLLHCNGVDDCGNQADEDNCGDNNGWSMQFDKYFASYYKMTSQYPFEAETPECLVGSVPVQCLCQGLELDCDETNLRAVPSVSSNVTAMSLQWNLIRKLPPDCFKNYHDLQKLYLQNNKITSISIYAFRGLNSLTKLYLSHNRITFLKPGVFEDLHRLEWLIIEDNHLSRISPPTFYGLNSLILLVLMNNVLTRLPDKPLCQHMPRLHWLDLEGNHIHNLRNLTFISCSNLTVLVMRKNKINHLNENTFAPLQKLDELDLGSNKIENLPPLIFKDLKELSQLNLSYNPIQKIQANQFDYLVKLKSLSLEGIEISNIQQRMFRPLMNLSHIYFKKFQYCGYAPHVRSCKPNTDGISSLENLLASIIQRVFVWVVSAVTCFGNIFVICMRPYIRSENKLYAMSIISLCCADCLMGIYLFVIGGFDLKFRGEYNKHAQLWMESTHCQLVGSLAILSTEVSVLLLTFLTLEKYICIVYPFRCVRPGKCRTITVLILIWITGFIVAFIPLSNKEFFKNYYGTNGVCFPLHSEDTESIGAQIYSVAIFLGINLAAFIIIVFSYGSMFYSVHQSAITATEIRNQVKKEMILAKRFFFIVFTDALCWIPIFVVKFLSLLQVEIPGTITSWVVIFILPINSALNPILYTLTTRPFKEMIHRFWYNYRQRKSMDSKGQKTYAPSFIWVEMWPLQEMPPELMKPDLFTYPCEMSLISQSTRLNSYS

SEQ ID NO: 158 - protein, 396 aa, Homo sapiens
MFRPLVNLSHIYFKKFQYCGYAPHVRSCKPNTDGISSLENLLASIIQRVFVWVVSAVTCFGNIFVICMRPYIRSENKLYAMSIISLCCADCLMGIYLFVIGGFDLKFRGEYNKHAQLWMESTHCQLVGSLAILSTEVSVLLLTFLTLEKYICIVYPFRCVRPGKCRTITVLILIWITGFIVAFIPLSNKEFFKNYYGTNGVCFPLHSEDTESIGAQIYSVAIFLGINLAAFIIIVFSYGSMFYSVHQSAITATEIRNQVKKEMILAKRFFFIVFTDALCWIPIFVVKFLSLLQVEIPGTITSWVVIFILPINSALNPILYTLTTRPFKEMIHRFWYNYRQRKSMDSKGQKTYAPSFIWVEMWPLQEMPPELMKPDLFTYPCEMSLISQSTRLNSYS

SEQ ID NO: 159 - protein, 359 aa, Drosophila melanogaster
MTPRVRMCKPSTDGVSSFQDLLSKPVLRYSAWVMATLTIAGNVLVLWGRFIYRDENVAVTMVIRNLALADMLMGFYLVTIGVQDYRYRNEYYKVVLDWITSWQCTLIGTLAVSSSEVSMLILAFMSLERFLLIADPFRGHRSIGNRVMWLALICIWITGVGLAVAPVLLWRTSTLPYYGSYSGTCFPLHIHEAFPMGWLYSAFVFLGVNLLLLVMIAMLYTALLISIWRTRSATPLTLLDCEFAVRFFFIVLTDFLCWVPIIVMKIWVFFNYNISDDIYAWLVVFVLPLNSAVNPLLYTFTTPKYRNQIFLRGWKKITSRKRAEAGNGNVATTTTGTATGSSQHPDDFTIFAKAAMRCH

SEQ ID NO: 160 - protein, 1115 aa, Lymnaeidae gen. sp.
MATMSGTTIVCLIYLTTMLGNSQGVNLKIESPSPPTLCSVEGTFHCDDGMLQCVLMGSKCDGVSDCENGMDESVETCGCLQSEFQCNHTTCIDKILRCDRNDDCSNGLDERECDIYICPLGTHVKWHNHFCVPRDKQCDFLDDCGDNSDEKICERRECVATEFKCNNSQCVAFGNLCDGLVDCVDGSDEDQVACDSDKYFQCAEGSLIKKEFVCDGWVDCKLTFADELNCKLCDEDDFRCSDTRCIQKSNVCDGYCDCKTCDDEEVCANNTYGCPMDTKYMCRSIYGEPRCIDKDNVCNMINDCRDGNVGTDEYYCSNDSECKNFQAAMGFFYCPEERCLAKHLYCDLHPDCINGEDEQSCLAPPKCSQDEFQCHHGKCIPISKRCDSVHDCVDWSDEMNCENHQCAANMKSCLSGHCIEEHKWCNFHRECPDGSDEKDCDPRPVCEANQFRCKNGQCIDPLQVCVKGDKYDGCADQSHLINCSQHICLEGQFRCRKSFCINQTKVCDGTVDCLQGMWDENNCRYWCPHGQAICQCEGVTMDCTGQKLKEMPVQQMEEDLSKLMIGDNLLNLTSTTFSATYYDKVTYLDLSRNHLTEIPIYSFQNMWKLTHLNLADNNITSLKNGSLLGLSNLKQLHINGNKIETIEEDTFSSMIHLTVLDLSNQRLTHVYKNMFKGLKQITVLNISRNQINSIDNGAFNNLANVRLIDLSGNVIKDIGQKVFMGLPRLVELKTDSYRFCCLAPEGVKCSPKQDEFSSCEDLMSNHVLRVSIWVLGVIALVGNFVVIFWRVRDFRGGKVHSFLITNLAIGDFLMGVYLLIIATADTYYRGVYISHDENWKQSGLCQFAGFVSTFSSELSVLTLSTITLDRLICILFPLRRTRLGLRQAIIVMSCIWVLVFLLAVLPLLGFSYFENFYGRSGVCLALHVTPDRRPGWEYSVGVFILLNLLSFVLIASSYLWMFSVAKKTRSAVRTAESKNDNAMARRMTLIVMTDFCCWVPIIVLGFVSLAGARADDQVYAWIAVFVLPLNSATNPVIYTLSTAPFLGNVRKRANRFRKSFIHSFTGDTKHSYVDDGTTHSYCEKKSPYRQLELKRLRSLNSSPPMYYNTELHSDS

SEQ ID NO: 161 - protein, 204 aa, Artificial Sequence
  Description of Artificial Sequence: 7tm_1 domain consensus sequence
SALCKLVTALDVVNMYASILLLTAISIDRYLAIVHPLRYRRRRTSPRRAKVVILLVWVLALLLSLPPLLFSWVKTVEEGNGTLNVNVTVCLIDFPEESTASVSTWLRSYVLLSTLVGFLLPLLVILVCYTRILRTLRKAAKTLLVVVVVFVLCWLPYFIVLLLDTLCLSIIMSSTCELERVLPTALLVTLWLAYVNSCLNPIIY

SEQ ID NO: 162 - protein, 262 aa, Mus musculus
MARLSWGYGEHNGPIHWNELFPIADGDQQSPIEIKTKEVKYDSSLRPLSIKYDPASAKIISNSGHSFNVDFDDTEDKSVLRGGPLTGNYRLRQFHLHWGSADDHGSEHVVDGVRYAAELHVVHWNSDKYPSFVEAAHESDGLAVLGVFLQIGEHNPQLQKITDILDSIKEKGKQTRFTNFDPLCLLPSSWDYWTYPGSLTVPPLLESVTWIVLKQPISISSQQLARFRSLLCTAEGESAAFLLSNHRPPQPLKGRRVRASFY

SEQ ID NO: 163 - protein, 260 aa, Danio rerio
MAHAWGYGPADGPESWAESFPIANGPRQSPIDIVPTQAQHDPSLKHLKLKYDPATTKSILNNGHSFQVDFVDDDNSSTLAGGPITGIYRLRQFHFHWGSSDDKGSEHTIAGTKFPCELHLVHWNTKYPNFGEAASKPDGLAVVGVFLKIGAANPRLQKVLDALDDIKSKGRQTTFANFDPKTLLPASLDYWTYEGSLTTPPLLESVTWIVLKEPISVSPAQMAKFRSLLFSSEGETPCCMVDNYRPPQPLKGRKVRASFK

SEQ ID NO: 164 - protein, 261 aa, Homo sapiens
MASPDWGYDDKNGPEQWSKLYPIANGNNQSPVDIKTSETKHDTSLKPISVSYNPATAKEIINVGHSFHVNFEDNDNRSVLKGGPFSDSYRLFQFHFHWGSTNEHGSEHTVDGVKYSAELHVAHWNSAKYSSLAEAASKADGLAVIGVLMKVGEANPKLQKVLDALQAIKTKGKRAPFTNFDPSTLLPSSLDFWTYPGSLTHPPLYESVTWIICKESISVSSEQLAQFRSLLSNVEGDNAVPMQHNNRPTQPLKGRTVRASF

SEQ ID NO: 165 - protein, 261 aa, Gorilla gorilla
MASPDWGYDDKNGPEQWSKLYPIANGNNQSPVDIKTSETKHDTSLKPISVSYNPATAKEIINVGHSFHVTFEDNDNRSVLKGGPLSDSYRLFQFHFHWGSTNEHGSEHTVDGVKYSAELHLTHWNSAKYSSLAEAASKADGLAVIGVLMKVGEANPKLQKILDALQAIKTKGKRAPFTNFDPSTLLPSSLDFWTYPGSLTHPPLYESVTWIICKESISVSSEQLAQFRSLLSNVEGDNAVPMQHNNRPTQPLKGRTVRASF

SEQ ID NO: 166 - protein, 260 aa, Equus caballus
AHSDWGYDSPBGPZEWVKLYPIABGBBQSPIDIKTSETKHDTSLKPFSVSYDPATAKEIVNVGHSFQVKFEDSDNRSVLKDGPLPGSYRLVQFHFHWGSTDDYGSEHTVDGVKYSAELHLVHWNSSKYSSFDEASSQADGLAILGVLMKVGEANPKLQKVLDALNEVKTKGKKAPFKNFDPSSLLPSSPDYWTYSGSLTHPPLYESVTWIVCKENISISSQQLSQFRSLLSNVEGGKAVPIQHNNRPPQPLKGRTVRAFF

SEQ ID NO: 167 - protein, 283 aa, Artificial Sequence
  Description of Artificial Sequence: carb_anhydrase domain consensus sequence
WGYGEHNGPEHSNNAHVLWHKLYPIANGGNCQGERQSPINIQTKEAKYDPSLKPLSLSYDAATAKEFEIVNNGHSFQVEFDDSDDKSVLSGGPLPAGHPYRLKQFHFHWGGASSDDQGSEHTVDGKKYAAELHLVHWNSTKYGSYKEAVSKPDGLAVLGVFLKVGDYQENPGLQKVVDALSSIKTKGKSATFTNFDPSTLLPSEKLRDYWTYPGSLTTPPLTESVTWIVLKEPISVSSEQLLKFRSLLFNAEGEEEVPGCDGIMVDNYRPTQPLKGRVVRASF

SEQ ID NO: 168 - protein, 416 aa, Bothrops jararaca
MWPLLFLIGATSAFAETTVHRFDGEKVYRVTPRNEDEVYFLNYLANIVQVDFWRPDSVELVKAEMTVDFRIEADRCSEVESILQQSGLNYEILIDNLQAVLDRQLDNHARTAGYNYEKYNSWEKIDAWTADIANENPSLVSRLQIGTTFEGRPMPLLKVGKPGVNKKAIFIDCGFHAREWISPAFCQWFVREAVRTYGKETIMTQLLNKLDFYILPVLNIDGYVYSWKQSRMWRKTRSVNAGSTCIGTDPNRNFDAAWCSVGASRNPCSETYCGSKPESEKETKALADFIRRNRSIIQAYLTIHSYSQMLLYPYSYTYDLTSNNKKLNSIAKEAIRELKVLFGTEYTYGPGAATIYPAAGGSDDWAYDQGIKYAFTFELRDKGRYGFALPESQIKPTCEETMIAVKYIAEYMLSLY

SEQ ID NO: 169 - protein, 349 aa, Unknown Organism
  Description of Unknown Organism:sequence 85 from Patent WO9620011
MKYLLPTAAAGLLLLAAQPAMAATGHSYEKYNKWETIEAWTQQVATENPALISRSVIGTTFEGRAIYLLKVGKAGQNKPAIFMDCGFHAREWISPAFCQWFVREAVRTYGREIQVTELLDKLDFYVLPVLNIDGYIYTWTKSRFWRKTRSTHTGSSCIGTDPNRNFDAGWCEIGASRNPCDETYCGPAAESEKETKALADFIRNKLSSIKAYLTIHSYSQMMIYPYSYAYKLGENNAELNALAKATVKELASLHGTKYTYGPGATTIYPAAGGSRDWAYDQGIRYSFTFELRDTGRYGFLLPESQIRATCEETFLAIKYVASYVLEHLYHHHHHHEFEEQKLISEEDLN

SEQ ID NO: 170 - protein, 349 aa, Unknown Organism
  Description of Unknown Organism:sequence 81 from Patent WO9620011
MKYLLPTAAAGLLLLAAQPAMAATGHSYEKYNKWETIEAWTQQVATENPALISRSVIGTTFEGRAIYLLKVGKAGQNKPAIFMDCGFHAREWISPAFCQWFVREAVRTYGREIQVTELLDKLDFYVLPVLNIDGYIYTWTKSRFWRKTRSTHTGSSCIGTDPNRNFDAGWCEIGASRNPCDETYCGPAAESEKETKALADFIRNKLSSIKAYLTIHSYSQMMIYPYSYAYKLGENNAELNALAKATVKELASLHGTKYTYGPGATTIYPAAGGSKDWAYDQGIRYSFTFELRDTGRYGFLLPESQIRATCEETFLAIKYVASYVLEHLYHHHHHHEFEEQKLISEEDLN

SEQ ID NO: 171 - protein, 349 aa, Unknown Organism; identical to SEQ ID NO: 170
  Description of Unknown Organism: sequence 68  from Patent WO9620011

SEQ ID NO: 172 - protein, 422 aa, Mus musculus
MKLHGLGILVAIILYEQHGFAFQSGQVLSALPRTSRQVQLLQNLTTTYEVVLWQPVTAEFIEKKKEVHFFVNASDVDSVKAHLNVSRIPFNVLMNNVEDLIEQQTFNDTVSPRASASYYEQYHSLNEIYSWIEVITEQHPDMLQKIYIGSSFEKYPLYVLKVSGKEQRIKNAIWIDCGIHAREWISPAFCLWFIGYVTQFHGKENLYTRLLRHVDFYIMPVMNVDGYDYTWKKNRMWRKNRSAHKNNRCVGTDLNRNFASKHWCEKGASSSSCSETYCGLYPESEPEVKAVADFLRRNIDHIKAYISMHSYSQQILFPYSYNRSKSKDHEELSLVASEAVRAIESINKNTRYTHGSGSESLYLAPGGSDDWIYDLGIKYSFTIELRDTGRYGFLLPERYIKPTCAEALAAISKIVWHVIRNT

SEQ ID NO: 173 - protein, 304 aa, Artificial Sequence
  Description of Artificial Sequence: Zn_carbOpept domain consensus sequence
YHNLEEIYAWLDLLVSNFPDLVSKVSIGKSYEGRDLKVLKISDNPATGENEPEVFAVAGWIHAREWVTSATLLWLLKELVANYGSDKTITKLLDGLDLFYILPVFNPDGYAYSITTDSYRMWRKTRSPNAGSFCVGTDPNRNWYAQWGGMGASSYSPCSETYEGTAPFSEPETKAVEDFIRSWLGGGKQNIKAYITFHSYSQLLLYPYGYDYNLNPDANDLDELSDLKIAADALSARHGTYYTLGLPGSSTIYPASAGGSDDWAYDVGIIKYAFTFELRPDTGSYGNPCFLLPEEQIIPTGSEE

SEQ ID NO: 174 - protein, 348 aa, Homo sapiens
MVNNFSQAEAVELCYKNVNESCIKTPYSPGPRSILYAVLGFGAVLAAFGNLLVMIAILHFKQLHTPTNFLIASLACADFLVGVTVMPFSTVRSVESCWYFGDSYCKFHTCFDTSFCFASLFHLCCISVDRYIAVTDPLTYPTKFTVSVSGICIVLSWFFSVTYSFSIFYTGANEEGIEELVVALTCVGGCQAPLNQNWVLLCFLLFFIPNVAMVFIYSKIFLVAKHQARKIESTASQAQSSSESYKERVAKRERKAAKTLGIAMAAFLVSWLPYLVDAVIDAYMNFITPPYVYEILVWCVYYNSAMNPLIYAFFYQWFGKAIKLIVSGKVLRTDSSTTNLFSEEVETD

SEQ ID NO: 175 - protein, 338 aa, Rattus norvegicus
MELCYENVNGSCIKSSYSPWPRAILYAVLGLGALLAVFGNLLVITAILHFKQLHTPTNFLVASLACADFLVGVTVMPFSTVRSVEGCWYFGDTYCKFHTCFDTSFCFASLFHLCCISIDRYVAVTDPLTYPTKFTISVSGVCIALSWFFSVTYSFSIFYTGANEEGIEELVVALTCVGGCQAPLNQNWVLLCFLLFFLPTVVMVFLYGRIFLVAKQQARKIEGSANQPQASSESYKERVARRERKAAKTLGIAMAAFLVSWLPYIIDAVIDAYMNFITPAYVYEILVWCVYYNSAMNPLIYAFFYPWFRKAIKLIVSGKVFRADSSRTNLFSEEAGAG

SEQ ID NO: 176 - protein, 358 aa, Rattus norvegicus
MDKLVDNFLSGQSRTMSEDLLSASSPQLCYENLNGSCIRSPYSPGPRLILYAVFGFGAVLAVCGNLLVMTSILHFRQLHSPANFLVASLACADFLVGLTVMPFSTVRSVEGCWYFGDTYCKFHSCFEGSFCYSSIFHLCFISVDRYIAVSDPLIYPTRFTASVSGKCITFSWLLSIIYSFSLLYTGANEAGLEDLVSALTCVGGCQIAVNQSWVFINFLLFLVPTLVMMTVYSKIFLIAKQQAQNIEKMSKQTTRASESYKDRVAKRERKAAKTLGIAVAAFLLSWLPYFIDSIIDAFLGFITPTYVYEILVWIAYYNSAMNPLIYAFFYPWFRKAIKLIVTGKILRQNSSVTNLFPE

SEQ ID NO: 177 - protein, 358 aa, Rattus norvegicus
MRVDDDRFPWDQDSILSRDLLSASSLQLCYENLNRSCVRSPYSPGPRLILYAVFGFGAVLAVCGNLMVMTSILHFRQLHSPANFLVASLACADFLVGLTVMPFSMVRSVEGCWYFGDTYCKLHTCFDVSFCYCSLFHLCFISVDRYIAVSDPLIYPTRFTASVSGKCITFSWLLSIIYGFPLIYTGASEAGLEDLVSALTCVGGCQIPMNQKFVLINFLLFLVPTLVMMTVYSKIFLIARQQAQNIEKMRKQTARASESYKDRVCKRERKAAKTLGIAVAAFLLSWLPYFIDSIIDAFLGFITPTYVYEILIWIVYYNSSMNPLIYAFFYPWFRKATKLIVTGKILRENSSTINLFPE

SEQ ID NO: 178 - protein, 333 aa, Rattus norvegicus
MQLCYEKLNRSCVRSPYSPGPRLILYAVFGFGAVLAVCGNLLVMTSILHFRQLHSPANFLVASLACADFLVGLTVMPFSMVRSVEGCWYFGDIYCKFHSSFDGSFCYSSIFHLCFISADRYIAVSDPLIYPTRFTASVSGKCITFSWLLSIIYSFSLFYTGVNEAGLEDLVSALTCVGGCQIAVNQSWVFINFLLFLVPALVMMTVYSKIFLIAKQQAQNIEKMGKQTARASESYKDRVAKRERKAAKTLGIAVAAFLLSWLPYFIDSIIDAFLGFVTPTYVYEILVWIGYYNSAMNPLIYAFFYPWFRKAIKLIVTGKILRENSSATNLFPE

SEQ ID NO: 179 - protein, 120 aa, Artificial Sequence
  Description of Artificial Sequence: 7tm_1 domain consensus sequence
GNLLVILVILRTKKLRTPTNIFILNLAVADLLFLLTLPPWALYYLVGGSEDWPFGSALCKLVTALDVVNMYASILLLTAISIDRYLAIVHPLRYRRRRTSPRRAKVVILLVWVLALLLSL

SEQ ID NO: 180 - protein, 94 aa, Artificial Sequence
  Description of Artificial Sequence: 7tm_1 domain consensus sequence
LLSTLVGFLLPLLVILVCYTRILRTLRKAAKTLLVVVVVFVLCWLPYFIVLLLDTLCLSIIMSSTCELERVLPTALLVTLWLAYVNSCLNPIIY

SEQ ID NO: 181 - protein, 311 aa, Coturnix coturnix
MAGELSIGAELPTSPLAMEYVNDFDLMKFDVKKEPLGRNDRSGRHCTRLQPAGSVSSTPISTPCSSVPSSPSFSPTEQKTHLEDLYWMANSYQQMNPEALNLTPEDAVEALIGSHQVSQQLQGFESFRAHHHHHHHHQHHHHQYPAVTHEDLAGSGHPHHHHHHHHHASPTPSTSSSSSQQLQTSHQQHPPSSSVEDRFSDDQLVSMSVRELNRHLRGFTKDEVIRLKQKRRTLKNRGYAQSCRYKRVQQKHHLENEKTQLIQQVEQLKQEVTRLARERDAYKLKCEKLASNGFREAGSTSDNPSSPEFFM

SEQ ID NO: 182 - protein, 311 aa, Gallus gallus
MAGELSIGAELPTSPLAMEYVNDFDLMKFDVKKEPLGRNDRSGRHCTRLQPAGSVSSTPISTPCSSVPSSPSFSPTEQKTHLEDLYWMANSYQQMNPEALNLTPEDAVEALIGSHQVSQQLQGFESFRAHHHHHHHHHQHHHQYPAVTHEDLAGSGHPHHHHHHHHQASPTPSTSSSSSQQLQTSHQQHPPSSSVEDRFSDDQLVSMSVRELNRHLRGFTKDEVIRLKQKRRTLKNRGYAQSCRYKRVQQKHHLENEKTQLIQQVEQLKQEVTRLARERDAYKLKCEKLASNGFREAGSTSDNPSSPEFFM

SEQ ID NO: 183 - protein, 327 aa, Danio rerio
MASELAMSSSDLPTSPLAMEYVNDFDLMKFEVKKEPVEPDRSISQCSRLIAGGSLSSTPMSTPCSSVPPSPSFSAPSPGSGSEQKAHLEDFYWMTGYQQQLNPEALGFSPEDAVEALISSSHQLQSFDGYARGQQFGSAAGAGGAMAGEEMGSAAAVVSAVIAAAAAQNGAPHHHHHHHHHHPAGHHHHHAAPGAQSNGASAGHPGHMHLDERFSDEQLVNMSVRELNRQLRGVSKEEVIRLKQKRRTLKNRGYAQSCRYKRVQQRHVLEGEKTQLMQQVDHLKQEISRLVRERDAYKEKYEKLISSGFRENGSSSDNNPSSPEFFM

SEQ ID NO: 184 - protein, 356 aa, Danio rerio
MSADLAMGPELPTSPLALEYVNDFDLMKFEVKKEAMAAHDRANIRQCNRLQPQGSVSSTPISTPCSSVPSSPSFSPTEQKNHLEELYWMPSGAYPQQIDPQTLSLTPEDAVEALIGATAHGHPPPPHVQQQLQAGAFDGYRGAHHHHGHAQQQQQQQPQHHHHQHQYGAIPHHPDDLSGHPGAHGHHPHHHHHHHHSQDPDSPSPTSPEQLHHRHHHHHHPHGHPGQQGHHGVGGGLNVEDRFSDDQLVTMSVRELNRHLRGFTKDEVIRLKQKRRTLKNRGYAQSCRFKRVQQKHLLENEKTQLINQVEQLKQEINRLARERDAYKLKCEKLTGANGFREAGSTSDNPSSPEFFM

SEQ ID NO: 185 - protein, 356 aa, Danio rerio
  VARIANT (205): Wherein "Xaa" is any amino acid.
  VARIANT (211): Wherein "Xaa" is any amino acid.
MSADLAMGPELPTSPLALEYVNDFDLMKFEVKKEAMAAHDRANIRQCNRLQPQGSVSSTPISTPCSSVPSSPSFSPTEQKNHLEELYWMPSGAYPQQIDPQTLSLTPEDAVEALIGATAHGHPPPPHVQQQLQAGAFDGYRGAHHHHGHAQQQQQQQPQHHHHQHQYGAIPHHPDDLSGHPGAHGHHPHHHHHHHHSQDPDSPSXTSPEQXHHRHHHHHHPHGHPGQQGHHGVGGGLNVEDRFSDDQLVTMSVRELNRHLRGFTKDEVIRLKQKRRTLKNRGYAQSCRFKRVQQKHLLENEKTQLINQVEQLKQEINRLARERDAYKLKCEKLTGANGFREAGSTSDNPSSPEFFM

SEQ ID NO: 186 - protein, 208 aa, Artificial Sequence
  Description of Artificial Sequence: bZIP_Maf domain consensus sequence
ASKESKAQSAQLSPTSPPGAGHVAPASAGGGGGAGSGYTIMSGVGGGSCVITRAALQPCRPLNQQLMSSSGSVSPSAGSGAPSPLSLEDRFSDEQLVSMSVRELNRTLKLRGLSKEEVVRLKQKRRTLKNRGYAQSCRAKRVQQKHELEKEKAQLAQQLEQLKEEVSRLARERDAYKAKYERLLSFIVPVARSPVSGAGEAGSSSDSP

SEQ ID NO: 187 - protein, 756 aa, Homo sapiens
MAWSPPATLFLFLLLLGQPPPSRPQSLGTTKLRLVGPESKPEEGRLEVLHQGQWGTVCDDNFAIQEATVACRQLGFEAALTWAHSAKYGQGEGPIWLDNVRCVGTESSLDQCGSNGWGVSDCSHSEDVGVICHPRRHRGYLSETVSNALGPQGRRLEEVRLKPILASAKQHSPVTEGAVEVKYEGHWRQVCDQGWTMNNSRVVCGMLGFPSEVPVDSHYYRKVWDLKMRDPKSRLKSLTNKNSFWIHQVTCLGTEPHMANCQVQVAPARGKLRPACPGGMHAVVSCVAGPHFRPPKTKPQRKGSWAEEPRVRLRSGAQVGEGRVEVLMNRQWGTVCDHRWNLISASVVCRQLGFGSAREALFGARLGQGLGPIHLSEVRCRGYERTLSDCPALEGSQNGCQHENDAAVRCNVPNMGFQNQVRLAGGRIPEEGLLEVQVEVNGVPRWGSVCSENWGLTEAMVACRQLGLGFAIHAYKETWFWSGTPRAQEVVMSGVRCSGTELALQQCQRHGPVHCSHGGGRFLAGVSCMDSAPDLVMNAQLVQETAYLEDRPLSQLYCAHEENCLSKSADHMDWPYGYRRLLRFSTQIYNLGRTDFRPKTGRDSWVWHQCHRHYHSIEVFTHYDLLTLNGSKVAEGHKASFCLEDTNCPTGLQRRYACANFGEQGVTVGCWDTYRHDIDCQWVDITDVGPGNYIFQVIVNPHYEVAESDFSNNMLQCRCKYDGHRVWLHNCHTGNSYPANAELSLEQEQRLRNNLI

SEQ ID NO: 188 - protein, 756 aa, Homo sapiens [sequence omitted]

SEQ ID NO: 189 - protein, 756 aa, Homo sapiens
MARSPPATLFLFLLLLGQPPPSRPQSLGTTKLRLVGPESKPEEGRLEVLHQGQWGTVCDDNFAIQEATVACRQLGFEAALTWAHSAKYGQGEGPIWLDNVQCVGTESSLDQCGSNGWGVSDCSHSEDVGVICHPRRHRGYLSETVSNALGPQGRRLEEVRLKPILASAKQHSPVTEGAVEVKYEGHWRQVCDQGWTMNNSRVVCGMLGFPSEVPVDSHYYRKVWDLKMRDPKSRLKSLTNKNSFWIHQVTCLGTEPHMANCQVQVAPARGKLRPACPGGMHAVVSCVAGPHFRPPKTKPQRKGSWAEEPRVRLRSGAQVGEGRVEVLMNRQWGTVCDHRWNLISASVVCRQLGFGSAREALFGARLGQGLGPIHLSEVRCRGYERTLSDCPALEGSQNGCQHENAAAVRCNVPNMGFQNQVRLAGGRIPEEGLLEVQVEVNGVPRWGSVCSENWGLTEAMVACRQLGLGFAIHAYKETWFWSGTPRAQEVVMSGVRCSGTELALQQCQRHGPVHCSHGGGRFLAGVSCMDSAPDLVMNAQLVQETAYLEDRPLSQLYCAHEENCLSKSADHMDWPYGYRRLLRFSTQIYNLGRTDFRPKTGRDSWVWHQCHRHYHSIEVFTHYDLLTLNGSKVAEGHKASFCLEDTNCPTGLQRRYACANFGEQGVTVGCWDTYRHDIDCQWVDITDVGPGNYIFQVIVNPHYEVAESDFSNNMLQCRCKYDGHRVWLHNCHTGNSYPANAELSLEQEQRLRNNLI

SEQ ID NO: 190 - protein, 757 aa, Mus musculus
MMWPQPPTFSLFLLLLLSQAPSSRPQSSGTKKLRLVGPADRPEEGRLEVLHQGQWGTVCDDDFALQEATVACRQLGFESALTWAHSAKYGQGEGPIWLDNVRCLGTEKTLDQCGSNGWGISDCRHSEDVGVVCHPRRQHGYHSEKVSNALGPQGRRLEEVRLKPILASAKRHSPVTEGAVEVRYDGHWRQVCDQGWTMNNSRVVCGMLGFPSQTSVNSHYYRKVWNLKMKDPKSRLNSLTKKNSFWIHRVDCFGTEPHLAKCQVQVAPGRGKLRPACPGGMHAVVSCVAGPHFRRQKPKPTRKESHAEELKVRLRSGAQVGEGRVEVLMNRQWGTVCDHRWNLISASVVCRQLGFGSAREALFGAQLGQGLGPIHLSEVRCRGYERTLGDCLALEGSQNGCQHANDAAVRCNIPDMGFQNKVRLAGGRNSEEGVVEVQVEVNGGPRWGTVCSDHWGLTEAMVTCRQLGLGFANFALKDTWYWQGTPEAKEVVMSGVRCSGTEMALQQCQRHGPVHCSHGPGRFSAGVACMNSAPDLVMNAQLVQETAYLEDRPLSMLYCAHEENCLSKSADHMDWPYGYRRLLRFSSQIYNLGRADFRPKAGRHSWIWHQCHRHNHSIEVFTHYDLLTLNGSKVAEGHKASFCLEDTNCPSGVQRRYACANFGEQGVAVGCWDTYRHDIDCQWVDITDVGPGDYIFQVVVNPTNDVAESDFSNNMIRCRCKYDGQRVWLHNCHTGDSYRANAELSLEQEQRLRNNLI

SEQ ID NO: 191 - protein, 774 aa, Homo sapiens
MERPLCSHLCSCLAMLALLSPLSLAQYDSWPHYPEYFQQPAPEYHQPQAPANVAKIQLRLAGQKRKHSEGRVEVYYDGQWGTVCDDDFSIHAAHVVCRELGYVEAKSWTASSSYGKGEGPIWLDNLHCTGNEATLAACTSNGWGVTDCKHTEDVGVVCSDKRIPGFKFDNSLINQIENLNIQVEDIRIRAILSTYRKRTPVMEGYVEVKEGKTWKQICDKHWTAKNSRVVCGMFGFPGERTYNTKVYKMFASRRKQRYWPFSMDCTGTEAHISSCKLGPQVSLDPMKNVTCENGLPAVVSCVPGQVFSPDGPSRFRKAYKPEQPLVRLRGGAYIGEGRVEVLKNGEWGTVCDDKWDLVSASVVCRELGFGSAKEAVTGSRLGQGIGPIHLNEIQCTGNEKSIIDCKFNAESQGCNHEEDAGVRCNTPAMGLQKKLRLNGGRNPYEGRVEVLVERNGSLVWGMVCGQNWGIVEAMVVCRQLGLGFASNAFQETWYWHGDVNSNKVVMSGVKCSGTELSLAHCRHDGEDVACPQGGVQYGAGVACSETAPDLVLNAEMVQQTTYLEDRPMFMLQCAMEENCLSASAAQTDPTTGYRRLLRFSSQIHNNGQSDFRPKNGRHAWIWHDCHRHYHSMEVFTHYDLLNLNGTKVAEGHKASFCLEDTECEGDIQKNYECANFGDQGITMGCWDMYRHDIDCQWVDITDVPPGDYLFQVVINPNFEVAESDYSNNIMKCRSRYDGHRIWMYNCHIGGSFSEETEKKFEHFSGLLNNQLSPQ

SEQ ID NO: 192 - protein, 206 aa, Artificial Sequence
  Description of Artificial Sequence: Lysyl_oxidase domain consensus sequence
PDLVLDPALVQETAYVEDRPLYLLRCAAEENCLASSAYRAEAWDYDHRRLLRFSSRVKNLGRADFRPKAPRHSWEWHSCHQHYHSMDEFTHYDLLDANGTKKVAEGHKASFCLEDTECDEGVLKRYACTNHGTQGLSVGCYDTYRADIDCQWIDITDVKPGNYILKVEVNPKYEVAESDFTNNVVRCNIKYDGHRVYASNCHIGDA

SEQ ID NO: 193 - protein, 268 aa, Gallus gallus
MKRCCEGVGLPCLFKGVGMASSRPPKYLLVFDFDGTIINESSDDSIVRAAPGQALPEHIRQSFREGFYNEYMQRVLAYMGDQGVKMGDFKAVYENIPLSPGMPDLFQFLSKNHELFEIILISDANMFGIECKLRAAGFYSLFRKIFSNPSSFDKRGYFTLGPYHSHKCLDCPANTCKRKILTEYLAERAQEEVEFERVFYVGDGANDFCPSVTLTSADVAFPRKGYPMHQMTQEMEKKQPGTFQATVVPWESATEVARYLQELLKKKC

SEQ ID NO: 194 - protein, 241 aa, Mus musculus
MKVLLVFDFDNTIIDDNSDTWIVQCAPDKKLPIELQDSYQKGLWTEFMGRVFKYLRDEGVKADELKRAVTSLPFTSGMIELLSFLRMNKDRFDCIIISDSNSIFIDWVLEAAAFHDVFDHVFTNPASFDSSGRLTVKNYHAHSCTRCPKNLCKNTVLGEFIDKQLQKGVRYTRIVYIGDGGNDVCPVTFLKKNDVAMPREGYTLHRTLAKMSQNLEPMESSIVVWSSGVEIISHLQFLIKM

SEQ ID NO: 195 - protein, 306 aa, Drosophila melanogaster
MSSNQEQSPAAVAAAVASCRLRKQQRRRLAAFDFDHTIVSQNTDTVVRDLLPTEVTSAKVNELVENDCWTEYMAEVFRLLHEQQVSEARIRDTIRGIPEVPGFVRLIKHLAKRLHYDLIIISDSNSVFIDEWLRAHNLADCFVAIFTNPAEFDASGRLMVRAHHQQSDCKLSASNLCKGRVLEHFVIEQDLRRSIRYDHVFYVGDGNNDICPVLRQRACDFACARKGFAMEKHLLRNRSKLKLRAQLLIWKSGFDLMDQMLALPQLKTPQVQGDGDQPDQDADTDGKVPEVARRASAVAGPTKSPN

SEQ ID NO: 196 - protein, 245 aa, Arabidopsis thaliana
MAKIVILFDFDRTLIDGDSDNWVVTEMGLTEIFHQLRFTLPWNRLMDRMMMELQSQGRSIDDIKSCLKKMPIDSHIIEAIKSAKSSGCDLKIVSDANQFFIEKILEHHDLVDCFSEIYTNPTSLDDNGNLRILPYHSDALPPHSCNLCPSNLCKGLVMDHLRASSSNDQIPRRFIYLGDGGGDFCPTLKLRECDFVMPRTNYPLWKKISDNPLLIKAEVKEWSSAEEQQRILLQLVSTITKEEDS

SEQ ID NO: 197 - protein, 279 aa, Arabidopsis thaliana
MAKNNNIVIVFDFDKTIIDVDSDNWVVDELGFTDLFNQLLPTMPWNSLMNRMMKELHDHGKTIEEIKQVLRRIPIHPRVIPAIKSAHALGCELRIVSDANTLFIETIIEHLGIGEFFSEINTNPGLVDEQGRLIVSPYHDFTKSSHGCSRCPPNMCKGLIIDRIQASLTKEGKTSKMIYLGDGAGDYCPSLGLKAEDYMMPRKNFPVWDLISQNPMLVKATVRDWTDGEDMERILMEIINEIMSSEEGEENDKMLSSENCKISVGIVHEPIQVPLNLVK

SEQ ID NO: 198 - protein, 184 aa, Artificial Sequence
  Description of Artificial Sequence: Hydrolase domain consensus sequence
IKAVVFDKDGTLTDGKEPPIAEAIVEALRELGLAPLEEVEKLLGRGLGERILLEGGLTAELLLDEVLGLIALDKLYPGAREALKALKERGIKVAILTNGDRNAEALLEALGLALFDAIVDSDEVGGVGPVVVGKPKPEIFLLALERLGVKPEEVGPKVLMVGDGINDAPALAAAGVGVAMGNGG

SEQ ID NO: 199 - protein, 687 aa, Homo sapiens
MEELVGLREGFSGDPVTLQELWGPCPHIRRAIQGGLEWLKQKVFRLGEDWYFLMTLGVLMALVSYAMNFAIGCVVRAHQWLYREIGDSHLLRYLSWTVYPVALVSFSSGFSQSITPSSGGSGIPELKTMLAGVILEDYLDIKNFGAKVVGLSCTLATGSTLFLGKVGPFVHLSVMIAAYLGRVRTTTIGEPENKSKQNEMLVAAAAVGVATVFAAPFSGVLFSIEVMSSHFSVRDYWRGFFAATCGAFIFRLLAVFNSEQETITSLYKTSFRVDVPFDLPEIFFFVALGGICGVLSCAYLFCQRTFLSFIKTNRYSSKLLATSKPVYSALATLLLASITYPPGVGHFLASRLSMKQHLDSLFDNHSWALMTQNSSPPWPEELDPQHLWWEWYHPRFTIFGTLAFFLVMKFWMLILATTIPMPAGYFMPIFILGAAIGRLLGEALAVAFPEGIVTGGVTNPIMPGGYALAGAAAFSGAVTHTISTALLAFELTGQIVHALPVLMAVLAANAIAQSCQPSFYDGTIIVKKLPYLPRILGRNIGSHHVRVEHFMNHSITTLAKDTPLEEVVKVVTSTDVTEYPLVESTESQILVGIVQRAQLVQALQAEPPSRAPGHQQCLQDILARGCPTEPVTLTLFSETTLHQAQNLFKLLNLQSLFVTSRGRAVGCVSWVEMKKAISNLTNPPAPK

SEQ ID NO: 200 - protein, 687 aa, Homo sapiens
MEEFVGLREGSSGNPVTLQELWGPCPLIRRGIRGGLEWLKQKLFRLGEDWYFLMTLGVLMALVSCAMDLAVESVVRAHQWLYREIGDSHLLRYLSWTVYPVALVSFSSGFSQSITPSSGGSGIPEVKTMLAGVVLEDYLDIKNFGAKVVGLSCTLACGSTLFLGKVGPFVHLSVMMAAYLGRVRTTTIGEPENKSKQNEMLVAAAAVGVATVFGAPFSGVLFSIEVMSSHFSVWDYWRGFFAATCGAFMFRLLAVFNSEQETITSLYKTSFRVDVPFDLPEIFFFVVLGGLCGILGSAYLFCQRIFFGFIRNNRFSSKLLATSKPVYSALATLVLASITYPPSAGRFLASRLSMKQHLDSLFDNHSWALMTQNSSPPWPEELDPQHLWWEWYHPRFTIFGTLAFFLVMKFWMLILATTIPMPAGYFMPIFVYGAAIGRLFGETLSFIFPEGIVAGGITNPIMPGGYALAGAAAFSGAVTHTISTALLAFEVTGQIVHALPVLMAVLAANAIAQSCQPSFYDGTVIVKKLPYLPRILGRNIGSHRVRVEHFMNHSITTLAKDTPLEEVVKVVTSTDVAEYPLVESTESQILVGIVRRAQLVQALKAEPPSWAPGHQQCLQDILAAGCPTEPVTLKLSPETSLHEAHNLFELLNLHSLFVTSRGRAVGCVSWVEMKKAISNLTNPPAPK

SEQ ID NO: 201 - protein, 687 aa, Orycctolagus cuniculus
MEELVGLREGSSGNPVALRELWGPCPRLRRGIRGGLEWLKQKLFRVGEDWYFLMTLGVLMALISYAMNFALGRVVRAHKWLYREIGDSHLLRYLSWTVYPVALVSFSSGFSQSITPFSGGSGIPELKTILSGVVLENYLDIKNFGAKVVGLSCTLATGSTLFLGKVGPFVHLSVMIAAYLGRVRTKTIGEAENKSKQNEMLVAGAAVGVATVFAAPFSGVLFCIEVMSSHFSVWDYWRGFFAATCGAFMFRLLAVFNSEQETITSLYKTSFPVDVPFDLPEIFFFVLLGAICGVASCAYLYCQRTFLAFTKTNKLISKLMATSKPLYAALAATVLASITYPPGVGRFMASRLSMREHLDTLFDNHSWALLTRNSSPPWPAEPDPQHLWWEWYHPRFTIFGTLAFFLVMKFWMLILATTIPMPAGYFLPIFIIGAAIGRLLGEALSVAFPEGIVAGGVINPIMPGGYALAGAAAFSGAVTHSISTALLAFELTGQIVHALPVLMAVLAANAIAQSCQPSFYDGTIMVKKLPYLPWIRGRPINSHRVIVEHFMRRAISTLARDAALEQVVKVLTSTDEAEYPLVESTESQLLVGIVQRAQLVQALQAEAPARASGQQRCLQDILAGGCPTEPVTLTLSPETSLHQAHNLFELLNLRSLYVTSKGRAVGYVSWVELEKAISALTNPPPAK

SEQ ID NO: 202 - protein, 678 aa, Orycctolagus cuniculus
MEELVGLREGSSGNPVALRELWSPCPRLRRGIRGGLEWLKQKLFRVGEDWYFLMTLGVLMALISYAMNFALGRVVRAHKWLYREIGDSHLLRYLSWTVYPVALVSFSSGFSQSITPFSGGSGIPELKTILSGVVLENYLDIKNFGAKVVGLSCTLATGSTLFLGKVGPFVHLSVMIAAYLGRVRTKTIGEAENKSKQNEMLVAGAAVGVATVFAAPFSGVLFCIEVMSSHFSVWDYWRGFFAATCGAFMFRLLAVFNSEQETITSLYKTSFPVDVPFDLPEIFFFVLLGAICGVASCAYLYCQRTFLAFTKTNKLISKLMATSKPLYAALAATVLASITYPPGVGRFMASRLSMREHLDTLFDNHSWALLTRNSSPPWPAEPDPQHLWWEWYHPRFTIFGTLAFFLVMKFWMLILATTIPMPAGYFLPIFIIGAAIGRLLGEALSVAFPEGIVAGGVINPIMPGGYALAGAAAFSGAVTHSISTALLAFELTGQIVHALPVLMAVLAANAIAQSCQPSFYDGTIMVKKLPYLPWIRGRPINSHRVIVEHFMRRAISTLARDAALEQVVKVLTSTDEAEYPLVESTESQLLVGIVQRAQLVQALQAEAPARASGQQRCLQDILAGGCPTEPVTLTLSPETSLHQAHNLFELLNLRSLYVTSKGRAVVYVSWVERQHTGF

SEQ ID NO: 203 - protein, 687 aa, Orycctolagus cuniculus
MEELVGLREGSSGKPVTLQELWGPCPRIRRGVRRGLEWLKERLFRVGEDWHFLVALGVLMALISYAMNFAIGRVVRAHKWLYREVGDGHLLRYLSWTVYPVALLSFSSGFSQSISPFSGGSGLPELKTMLSGVVLEDYLDIKNFGAKVVGLSCTLATGSTIFLGKVGPFVHLSVMISAYLGRVRAKTIGETENKAKEIEMLSAAAAVGVATVFAAPFSGVLFSIEVMSSHFSVWNYWRGFFAATCGAFMFRLLGVFNSEQETITSVYKTRFRVDVPFDLPEIFFFVALGFICGVLSCAYLFCQRTFLRFIKTNRYTSRLLATSKPSYAALVALVLASITYPPGVGRFMASRLSMAEHLHSLFDNNSWALMTRNSSPPWPAEPDPQNLWLEWCHPRFTIFGTLAFFLVMKFWMLILATTIPMPAGYFMPIFIIGAAIGRLLGEALSVAFPEGIVAGREVNPIMPGGYALAGAAAFSGAVTHTISTALLAFELTGQIVHALPVLMAVLAANAISQNCQPSFYDGTIMAKKLPYLPRIRGRQIGSYPVTVEHFMNCNLTTLAKDTPLEEVVKVVTSTEVSQYPLVETRESQTLVGIVERTHLVQALQTQPTPWAPGQERFLQDILAGGCPTQPVTLQLSPETSLYQAHSLFERLTLQSLFVTSRGKAVGSVSWAELKKAISTLINPPAPK

SEQ ID NO: 204 - protein, 454 aa, Artificial Sequence
  Description of Artificial Sequence: voltage_CLC domain consensus sequence
FSLGLVLLAALLVKKFAPAAAGSGIPEIKTILSGIKIVGKEYLRLRTLVVKVVGLALSLGSGLSLGKEGPFVHIGACIAALLSKLGSTSLRLQFSLFKYSEEDRRKDRRDLLAAGAAAGVAAAFGAPIGGVLFSLEEVSSENAYFRVKNLWRGLFFASAVAAFVLRLINSFFVSGKCGQFGTGLALFDVSFRTDRDPFTLFELPLFILLGIFGGLLGALFNRLNRKVLKFRKKNKYKSKIFGLPPVLEPALVGLLTGVLSFPLPLLLGCAGGLELVEGRTLNELFDNCTWGEYNDLASLLCDTPEDAVLSLFDHWNGPGEGDFSAFTLLLLLLIAKFILTILTFGIGVPGGLFVPSLVIGAAVGRLVGIAVERLIMAVLSHDWFPIGLFCEGFPDCILEPGLYAVVGAAAFLGGVVRMTVSLAVIVFELTGNLSVILPLMVAVLIAKAVADSLG

SEQ ID NO: 205 - protein, 188 aa, Mus musculus
MADSSIYSTLELPEAPQVQDESRWKLKAVLHRPHLSRFAMVALGLLTVILMSLLMYQRILCCGSKDSTCSHCPSCPILWTRNGSHCYYFSMEKKDWNSSLKFCADKGSHLLTFPDNQGVKLFGEYLGQDFYWIGLRNIDGWRWEGGPALSLRILTNSLIQRCGAIHRNGLQASSCEVALQWICKKVLY

SEQ ID NO: 206 - protein, 188 aa, Rattus norvegicus
MADNSIYSTLELPAAPRVQDDSRWKVKAVLHRPCVSYLVMVALGLLTVILMSLLLYQRTLCCGSKGFMCSQCSRCPNLWMRNGSHCYYFSMEKRDWNSSLKFCADKGSHLLTFPDNQGVNLFQEYVGEDFYWIGLRDIDGWRWEDGPALSLSILSNSVVQKCGTIHRCGLHASSCEVALQWICEKVLP

SEQ ID NO: 207 - protein, 189 aa, Homo sapiens
MTDSVIYSMLELPTATQAQNDYGPQQKSSSSRPSCSCLVAIALGLLTAVLLSVLLYQWILCQGSNYSTCASCPSCPDRWMKYGNHCYYFSVEEKDWNSSLEFCLARDSHLLVITDNQEMSLLQVFLSEAFCWIGLRNNSGWRWEDGSPLNFSRISSNSFVQTCGAINKNGLQASSCEVPLHWVCKKVRL

SEQ ID NO: 208 - protein, 195 aa, Homo sapiens
MTDSVIYSMLELPTATQAQNDYGPQQKSSSSRPSCSCLVAIALGLLTAVLLSVLLYQWILCQGSNYSTCASCPSCPDRWMKYGNHCYYFSVEEKDWNSSLEFCLARDSHLLVITDNQEMSLLQVFLSEAFCWIGLRNNSGWRWEDGSPLNFSRISSNSFVQTCGAINKNGLQASSCEVPLHWVCKKCPFADQALF

SEQ ID NO: 209 - protein, 189 aa, Homo sapiens [sequence omitted]

SEQ ID NO: 210 - protein, 32 aa, Artificial Sequence
  Description of Artificial Sequence: Xlink domian consensus sequence
GEVFHYRAPSGRYKLTFEEAQAACLRQGARIA

SEQ ID NO: 211 - protein, 1574 aa, Rattus norvegicus
MPVRAEARAAWRVVALALLLLPAMPAASPPLTPRPLQPSMPHVCAEQKLTLVGHRQPCVQAFSRIVPVWRRTGCAQQAWCIGQERRTVYYMSYRQVYATEARTVFRCCPGWSQKPGQEGCLSDVDECASANGGCEGPCCNTVGGFYCRCPPGYQLQGDGKTCQDVDECRAHNGGCQHRCVNTPGSYLCECKPGFRLHTDGRTCLAISSCTLGNGGCQHQCVQLTVTQHRCQCRPQYQLQEDGRRCVRRSPCAEGNGGCMHICQELRGLAHCGCHPGYQLAADRKTCEDVDECALGLAQCAHGCLNTQGSFKCVCHAGYELGADGRQCYRIEMEIVNSCEAGNGGCSHGCSHTSTGPLCTCPRGYELDEDQKTCIDIDDCANSPCCQQACANTPGGYECSCFAGYRLNTDGCGCEDVDECASGHGGCEHHCSNLAGSFQCFCEAGYRLDEDRRGCTSLEESVVDLDGRLPFVRPLPHIAVLRDELPRLFQDDYGAEEEAAAAELRGEHTLTEKFVCLDHSFGHDCSLTCDDCRNGGTCFPGQDGCDCPEGWTGIICNETCPPDTFGKNCSSPCTCQNGGTCDPVLGACRCPPGVSGAHCEDGCPKGFYGKHCRKKCHCANRGRCHRLYGACLCDPGLYGRFCHLACPPWAFGPGCSEDCLCEQSHTRSCNPKDGSCSCKAGFQGERCQAECESGFFGPGCRHRCTCQPGVACDPVSGECRTQCPPGYQGEDCGQECPVGTFGVNCSGSCSCVGAPCHRVTGECLCPPGKTGEDCGADCPEGRWGLGCQEICPACEHGASCNPETGTCLCLPGFVGSRCQDTCSAGWYGTGCQIRCACANDGHCDPTTGRCSCAPGWTGLSCQRACDSGHWGPDCIHPCNCSAGHGNCDAVSGLCLCEAGYEGPRCEQSCRQGYYGPSCEQKCRCEHGAACDHVSGACTCPAGWRGSFCEHACPAGFFGLDCDSACNCSAGAPCDAVTGSCICPAGRWGPRCAQSCPPLTFGLNCSQICTCFNGASCDSVTGQCHCAPGWMGPTCLQACPPGLYGKNCQHSCLCRNGGRCDPILGQCTCPEGWTGLACENECLPGHYAAGCQLNCSCLHGGICDRLTGHCLCPAGWTGDKCQSSCVSGTFGVHCEEHCACRKGASCHHVTGACFCPPGWRGPHCEQACPRGWFGEACAQRCLCPTNASCHHVTGECRCPPGFTGLSCEQACQPGTFGKDCEHLCQCPGETWACDPASGVCTCAAGYHGTGCLQRCPSGRYGPGCEHICKCLNGGTCDPATGACYCPAGFLGADCSLACPQGRFGPSCAHVCACRQGAACDPVSGACICSPGKTGVRCEHGCPQDRFGKGCELKCACRNGGLCHATNGSCSCPLGWMGPHCEHACPAGRYGAACLLECFCQNNGSCEPTTGACLCGPGFYGQACEHSCPSGFHGPGCQRVCECQQGAPCDPVSGQCLCPAGFHGQFCEKGCESGSFGDGCLQQCNCHTGVPCDPISGLCLCPPGRTGAACDLDCRRGRFGPGCALRCDCGGGADCDPISGQCHCVDSYMGPTCREVPTQISSSRPAPQHPSSRAMKH

SEQ ID NO: 212 - protein, 1664 aa, Caenorhabditis elegans
MDMRSCTHHLLPVSKLMVLCKFFCVDILNFTSIFFRELGEIEKLDFLPFNFHARKYLRFARFSRRGCSKCCLLRVQANCSADLCHNGGTCVPSEHNDNEQVCECPVGFTGAKCQYDANECMANNGGCEHECVNTIGTYYCRCWPGFELSGDGNTCSDIDECAVSNGGCSDRCVNSPGGFRCDCPSDLYLHADGRTCGSGFHFENLILIKKVTSCSTDNGGCEHECENDSNGEFYRCRCRVGFKLSENKRSCQPVDPCFDNKGGCQHHCTNNHGRAQCQCYPGFHLSYDRRSCVDIDECAKNNGCEHFCENVKGTYRCKCREGYQLGRDGRTCEEMLGGCQVGNGGCQHDCYDQPDGGHVCKCRNGYILANDQKLCHDINECHENNGDCSQICVNLAGSVECQCKPGFRLMKDRKTCEDISECSSNNGGCEQICSNQEGGYMCSCEPGFELSEDGHSCHDMNECLINNGGCAQLCKNRKGSRRCQCFAGYILAHDEKSCVAASDSADIFSNDIEDYSKVPGLDSIDEVISSIESYPADESPRPLVFGRRRHVKACVNFQGTLSLELFSSEVRTDPSEKCPNGFFGSTCQLSCSDCQNGGKCSMRGSGLLSKCDCPSGYTGEKCEQICRNGYWGVDCAHKCSCKLCDPSTGSCRCEDPEKCSDGPCPDGFYGSQCNLKCRMDCPNGRCDPVFGYCTCPDGLYGQSCEKPCPHFTFGKNCRFPCKCARENSEGCDEITGKCRCKPGYYGHHCKRMCSPGLFGAGCAMKCSCPAGIRCDPVTGDCTKKCPAGYQGNLCDQPCPAGYFGYDCEQKCSCADVASPHKSKVCHHVTGTCTCLPGKTGPLCDQSCAPNTYGPNCAHTCSCVNGAKCDESDGSCHCTPGFYGATCSEVCPTGRFGIDCMQLCKCQNGAICDTSNGSCECAPGWSGKKCDKACAPGTFGKDCSKKCDCADGMHCDPSDGECICPPGKKGHKCDETCDSGLFGAGCKGICSCQNGATCDSVTGSCECRPGWRGKKCDRPCPDGRFGEGCNAICDCTTTNDTSMYNPFVARCDHVTGECRCPAGWTGPDCQTSCPLGRHGEGCRHSCQCSNGASCDRVTGFCDCPSGFMGKNCESECPEGLWGSNCMKHCLCMHGGECNKENGDCECIDGWTGPSCEFLCPFGQFGRNCAQRCNCKNGASCDRKTGRCECLPGWSGEHCEKSCVSGHYGAKCEETCECENGALCDPISGHCSCQPGWRGKKCNRPCLKGYFGRHCSQSCRCANSKSCDHISGRCQCPKGYAGHSCTELCPDGTFGESCSQKCDCGENSMCDAISGKCFCKPGHSGSDCKSGCVQGRFGPDCNQLCSCENGGVCDSSTGSCVCPPGYIGTKCEIACQSDRFGPTCEKICNCENGGTCDRLTGQCRCLPGFTGMTCNQVCPEGRFGAGCKEKCRCANGHCNASSGECKCNLGFTGPSCEQSCPSGKYGLNCTLDCECYGQARCDPVQGCCDCPPGRYGSRCQFSCPNGFYGWYCSQSCSCQNGAHCDGADGRCLCPAGFQVKLANKKKNDLELGDKCEQKCSEGSFGPACSQQCNCGKYKCDATDGKCICPVGRHGPLCEEECRPGRYGQSCQNKCQCFNGATCDARTGQCSCSPGWLGPTCQIEMMDPNNVANRGDLPEDWEWRKKR

SEQ ID NO: 213 - protein, 1620 aa, Caenorhabditis elegans
MDMRSCTHHLLPVSKLMVLCKFFCVDILNFTSIFFRELGEIEKLDFLPFNFHARKYLRFARFSRRGCSKCCLLRVQANCSADLCHNGGTCVPSEHNDNEQVCECPVGFTGAKCQYDANECMANNGGCEHECVNTIGTYYCRCWPGFELSGDGNTCSDIDECAVSNGGCSDRCVNSPGGFRCDCPSDLYLHADGRTCGKVTSCSTDNGGCEHECENDSNGEFYRCRCRVGFKLSENKRSCQPVDPCFDNKGGCQHHCTNNHGRAQCQCYPGFHLSYDRRSCVDIDECAKNNGCEHFCENVKGTYRCKCREGYQLGRDGRTCEEMLGGCQVGNGGCQHDCYDQPDGGHVCKCRNGYILANDQKLCHDNISTVIHARAPRLWDSYETVTCVTPTDLTCHKLCMHLDSGHVQCFCDDGYELIDSKFCQDINECHENNGDCSQICVNLAGSVECQCKPGFRLMKDRKTCEDISECSSNNGGCEQICSNQEGGYMCSCEPGFELSEDGHSCHDMNECLINNGGCAQLCKNRKGSRRCQCFAGYILAHDEKSCVAASDSADIFSNDIEDYSKVPGLDSIDEVISSIESYPADESPRPLVFGRRRHVKACVNFQGTLSLELFSSEVRTDPSEKCPNGFFGSTCQLSCSDCQNGGKCSMRGSGLLSKCDCPSGYTGEKCEQICRNGYWGVDCAHKCSCKLCDPSTGSCRCEDPEKCSDGPCPDGFYGSQCNLKCRMDCPNGRCDPVFGYCTCPDGLYGQSCEKPCPHFTFGKNCRFPCKCARENSEGCDEITGKCRCKPGYYGHHCKRMCSPGLFGAGCAMKCSCPAGIRCDPVTGDCTKKCPAGYQGNLCDQPCPAGYFGYDCEQKCSCADVASPHKSKVCHHVTGTCTCLPGKTGPLCDQCLIFVETIEFDIAFSINVIACAPNTYGPNCAHTCSCVNGAKCDESDGSCHCTPGFYGATCSEVCPTGRFGIDCMQLCKCQNGAICDTSNGSCECAPGWSGKKCDKACAPGTFGKDCSKKCDCADGMHCDPSDGECICPPGKKGHKCDETCDSGLFGAGCKGICSCQNGATCDSVTGSCECRPGWRGKKCDRPCPDGRFGEGCNAICDCTTTNDTSMYNPFVARCDHVTGECRCPAGWTGPDCQTSCPLGRHGEGCRHSCQCSNGASCDRVTGFCDCPSGFMGKNCESECPEGLWGSNCMKHCLCMHGGECNKENGDCECIDGWTGPSLCPFGQFGRNCAQRCNCKNGASCDRKTGRCECLPGWSGEHCEKSCVSGHYGAKCEETCECENGALCDPISGHCSCQPGWRGKKCNRPCLKGYFGRHCSQSCRCANSKSCDHISGRCQCPKGYAGHSCTELCPDGTFGESCSQKCDCGENSMCDAISGKCFCKPGHSGSDCKSGCVQGRFGPDCNQLCSCENGGVCDSSTGSCVCPPGYIGTKCEIACQSDRFGPTCEKICNCENGGTCDRLTGQCRCLPGFTGMTCNQVCPEGRFGAGCKEKCRCANGHCNASSGECKCNLGFTGPSCEQSCPSGKYGLNCTLDCECYGQARCDPVQGCCDCPPGRYGSRCQFSCPNGFYGWYCSQSCSCQNGAHCDGADGRCLCPAGFQVKLANKKKNDLELVQNIEFF

SEQ ID NO: 214 - protein, 969 aa, Homo sapiens
MHTPSIRSITHDAQTSSTGSSAPGTALCTEECVHGRCVSPDTCHCEPGWGGPDCSSGCDSDHWGPHCSNRCQCQNGALCNPITGACVCAAGFRGWRCEELCAPGTHGKGCQLPCQCRHGASCDPRAGECLCAPGYTGVYCEELCPPGSHGAHCELRCPCQNGGTCHHITGECACPPGWTGAVCAQPCPPGTFGQNCSQDCPCHHGGQCDHVTGQCHCTAGYMGDRCQEECPFGSFGFQCSQRCDCHNGGQCSPTTGACECEPGYKGPRCQERLCPEGLHGPGCTLPCPCDADNTISCHPVTGACTCQPGWSGHHCNESCPVGYYGDGCQLPCTCQNGADCHSITGGCTCAPGFMGEVCAVSCAAGTYGPNCSSICSCNNGGTCSPVDGSCTCKEGWQGLDCTLPCPSGTWGLNCNESCTCANGAACSPIDGSCSCTPGWLGDTCELPCPDGTFGLNCSEHCDCSHADGCDPVTGHCCCLAGWTGIRCDSTCPPGRWGPNCSVSCSCENGGSCSPEDGSCECAPGFRGPLCQRICPPGFYGHGCAQPCPLCVHSSRPCHHISGICECLPGFSGALCNQVCAGGYFGQDCAQLCSCANNGTCSPIDGSCQCFPGWIGKDCSQACPPGFWGPACFHACSCHNGASCSAEDGACHCTPGWTGLFCTQRCPAAFFGKDCGRVCQCQNGASCDHISGKCTCRTGFTGQHCEQRCAPGTFGYGCQQLCECMNNSTCDHVTGTCYCSPGFKGIRCDQAALMMEELNPYTKISPALGAERHSVGAVTGIMLLLFFIVVLLGLFAWHRRRQKEKGRDLAPRVSYTPAMRMTSTDYSLSGACGMDRRQNTYIMDKGFKDYMKESVCSSSTCSLNSSENPYATIKDPPILTCKLPESSYVEMKSPVHMGSPYTDVPSLSTSNKNIYEVEPTVSVVQEGCGHNSSYIQNAYDLPRNSHIPGHYDLLPVRQSPANGPSQDKQS

SEQ ID NO: 215 - protein, 1140 aa, Homo sapiens
MVISLNSCLSFICLLLCHWIGTASPLNLEDPNVCSHWESYSVTVQESYPHPFDQIYYTSCTDILNWFKCTRHRVSYRTAYRHGEKTMYRRKSQCCPGFYESGEMCVPHCADKCVHGRCIAPNTCQCEPGWGGTNCSSACDGDHWGPHCTSRCQCKNGALCNPITGACHCAAGFRGWRCEDRCEQGTYGNDCHQRCQCQNGATCDHVTGECRCPPGYTGAFCEDLCPPGKHGPQCEQRCPCQNGGVCHHVTGECSCPSGWMGTVCGQPCPEGRFGKNCSQECQCHNGGTCDAATGQCHCSPGYTGERCQDECPVGTYGVLCAETCQCVNGGKCYHVSGACLCEAGFAGERCEARLCPEGLYGIKCDKRCPCHLENTHSCHPMSGECACKPGWSGLYCNETCSPGFYGEACQQICSCQNGADCDSVTGKCTCAPGFKGIDCSTPCPLGTYGINCSSRCGCKNDAVCSPVDGSCTCKAGWHGVDCSIRCPSGTWGFGCNLTCQCLNGGACNTLDGTCTCAPGWRGEKCELPCQDGTYGLNCAERCDCSHADGCHPTTGHCRCLPGWSGVHCDSVCAEGRWGPNCSLPCYCKNGASCSPDDGICECAPGFRGTTCQRICSPGFYGHRCSQTCPQCVHSSGPCHHITGLCDCLPGFTGALCNEVCPSGRFGKNCAGICTCTNNGTCNPIDRSCQCYPGWIGSDCSQPCPPAHWGPNCIHTCNCHNGAFCSAYDGECKCTPGWTGLYCTQRCPLGFYGKDCALICQCQNGADCDHISGQCTCRTGFMGRHCEQKCPSGTYGYGCRQICDCLNNSTCDHITGTCYCSPGWKGARCDQAGVIIVGNLNSLSRTSTALPADSYQIGAIAGIIILVLVVLFLLALFIIYRHKQKGKESSMPAVTYTPAMRVVNADYTISGTLPHSNGGNANSHYFTNPSYHTLTQCATSPHVNNRDRMTVTKSKNNQLFVNLKNVNPGKRGPVGDCTGTLPADWKHGGYLNELGAFGLDRSYMGKSLKDLGKNSEYNSSNCSLSSSENPYATIKDPPVLIPKSSECGYVEMKSPARRDSPYAEINNSTSANRNVYEVEPTVSVVQGVFSNNGRLSQDPYDLPKNSHIPCHYDLLPVRDSSSSPKQEDSGGSSSNSSSSSE

SEQ ID NO: 216 - protein, 45 aa, Artificial Sequence
  Description of Artificial Sequence: EGF domain consensus sequence
CAPNNPCSNGGTCVNTPGGSSDNFGGYTCECPPGDYYLSYTGKRC

SEQ ID NO: 217 - protein, 45 aa, Artificial Sequence; identical to SEQ ID NO: 216
  Description of Artificial Sequence: EGF domain consensus sequence

SEQ ID NO: 218 - protein, 45 aa, Artificial Sequence; identical to SEQ ID NO: 216
  Description of Artificial Sequence: EGF domain consensus sequence

SEQ ID NO: 219 - protein, 45 aa, Artificial Sequence; identical to SEQ ID NO: 216
  Description of Artificial Sequence: EGF domain consensus sequence

SEQ ID NO: 220 - protein, 318 aa, Mus musculus
MEGANQSTVAEFVLLGLSDHPKLEKTFFVLILLMYLVILLGNGVLILVSILDSHLHTPMYFFLGDLSFLDICYTTSSIPLVLDGFLTPRKTISFSGCAVQMFLSFAMGATECVLLGMMAFDRYVAICNPLRYPVVMNKSAYVPMAVSSWVAGGANSLVQISLAVQLPFCGDNVINHFTCEILAVLKLACADISINVISMGVANVIFLGVPVLFIFVSYIFILSTILRIPSAEGRKKAFSTCSAHLTVVLVFYGTILFMYGKPKSKDPLGADKQDVSDKLISLFYGVLTPMLNPIIYSLRNKDVKAAVRNLVGQKCLIQ

SEQ ID NO: 221 - protein, 319 aa, Mus musculus
MDRSNETAPLSGFILLGLSAHPKLEKTFFVLILMMYLVILLGNGVLILVSILDSHLHTPMYFFLGNLSFLDICYTTSSVPLILDSFLTPRKTISFSGCAVQMFLSFAMGATECVLLSMMAFDRYVAICNPLRYPVVMNKAAYVPMAASSWAGGITNSVVQTSLAMRLPFCGDNVINHFTCEILAVLKLACADISINVISMVVANMIFLAVPVLFIFVSYVFILVTILRIPSAEGRKKAFSTCSAHLTVVLVFYGTILFMYGKPKSKDPLGADKQDLADKLISLFYGVVTPMLNPIIYSLRNKDVRAAVRNLVGQKHLTE

SEQ ID NO: 222 - protein, 318 aa, Mus musculus
MDVSNQTTVTEFVLLGLSAHPKLEKTFFVLILSMYLVILLGNGVLILVSILDSHLHTPMYFFLGNLSFLDICYTTSSVPLVLDGFLTPRKTISFSGCAVQMFLSFAMGATECVLLGMMAFDRYVAICNPLRYPVVMNKAAYVPMAVSSWVAGGANSLVQISLAVQLPFCGDNVINHFICEILAVLKLACADISINVISMGVANVIFLGVPVLFIFVSYIFILSTILRIPSAEGRKKAFSTCSAHLTVVIIFYGTILFMYGKPKSKDPLGADKQDLADKLISLFYGLLTPMLNPIIYSLRNKDVKAAVRNLASHRCLTF

SEQ ID NO: 223 - protein, 319 aa, Mus musculus
MERSNKTTPVSSFILLGLSAHPKLEKTFFVLILLMYLVILLGNVVLILVSILDSHLHTPMYFFLGNLSFLDICYTTSSVPLILDSFLTPRKTISFSGCAVQMFLSFAMGATECVLLGMMAFDRYVAICNPLRYPVVMSKAAYVPMAAGSWVSGSITATVQISLAMTLPFCGDNVINHFTCEILAVLKLACADISINVISMAVANAMFLGVPVLFIFVSYIFILSTILRIPSAEGRKKAFSTCSAHLTVVLVFYGTILFMYGKPKSKDPLGADKQDLADKLISLFYGVVTPMLNPIIYSLRNKDVKAAVTNLVGQKHFKW

SEQ ID NO: 224 - protein, 319 aa, Homo sapiens
MEKANETSPVMGFVLLRLSAHPELEKTFFVLILLMYLVILLGNGVLILVTILDSRLHTPMYFFLGNLSFLDICFTTSSVPLVLDSFLTPQETISFSACAVQMALSFAMAGTECLLLSMMAFDRYVAICNPLRYSVIMSKAAYMPMAASSWAIGGAASVVHTSLAIQLPFCGDNVINHFTCEILAVLKLACADISINVISMEVTNVIFLGVPVLFISFSYVFIITTILRIPSAEGRKKVFSTCSAHLTVVIVFYGTLFFMYGKPKSKDSMGADKEDLSDKLIPLFYGVVTPMLNPIIYSLRNKDVKAAVRRLLRPKGFTQ

SEQ ID NO: 225 - protein, 259 aa, Artificial Sequence
  Description of Artificial Sequence: 7tm_1 domain consensus sequence
GNLLVILVILRTKKLRTPTNIFILNLAVADLLFLLTLPPWALYYLVGGSEDWPFGSALCKLVTALDVVNMYASILLLTAISIDRYLAIVHPLRYRRRRTSPRRAKVVILLVWVLALLLSLPPLLFSWVKTVEEGNGTLNVNVTVCLIDFPEESTASVSTWLRSYVLLSTLVGFLLPLLVILVCYTRILRTLRKAAKTLLVVVVVFVLCWLPYFIVLLLDTLCLSIIMSSTCELERVLPTALLVTLWLAYVNSCLNPIIY

SEQ ID NO: 226 - protein, 514 aa, Rattus exulans
MVPSLEEPAAAERETNEAQPPGPAPSDDAPLPVPGPSDVSDGSVEKVEVELTRSTGNQEPPEPPEGGWGWLVMLAAMWCNGSVFGIQNAYGVLFVSMLETFGAKDDDNMAFKAAWVGSLSMGMIFFCCPIVSVFTDMFGCRRTAVLGAAVGFVGLMSSSFVSSIEPLYFTYGVVFACGCSFAYQPSLVILGHYFKKRLGLVNGIVTAGSSVFTILLPLLLGNLTSTVGLCYTLRILCIFMFVLFLAGFTYRPLVPSSKEKESEDSRSSFFSRRKLSPPKKIFNFALFKETAYAVWAAGIPLALFGYFVPYVHLMNHVKERFKDVNNKEVLFMCIGVTSGVGRLLFGRIADYLPGVKKVYLQVLSFFFIGLTSMMIPLCSVFGALIALCLIMGLFDGCFISIMAPIAFELVGPQDASQAIGFLLGFMSIPMTVGPPVAGLLHDKLGSYDLAFYLAGIPPFIGGAVLCLIPWIHSKKQREISKNTGGEKMEKMLANQSSLLSSSSGIFKKESDSII

SEQ ID NO: 227 - protein, 613 aa, Homo sapiens
MGRGGGGLDVGGGGEGSRDRLSRDGLASWGAEPGGGGSGSGSSSPPSSSSCSSRNKYQPQSGSSGPSSHSPPAAMALQSQASEEAKGPWQEADQEQQEPVGSPEPESEPEPEPEPEPVPVPPPEPQPEPQPLPDPAPLPELEFESERVHEPEPTPTVETRGTARGFQPPEGGFGWVVVFAATWCNGSIFGIHNSVGILYSMLLEEEKEKNRQVEFQAAWVGALAMGMIFFCSPIVSIFTDRLGCRITATAGAAVAFIGLHTSSFTSSLSLRYFTYGILFGCGCSFAFQPSLVILGHYFQRRLGLANGVVSAGSSIFSMSFPFLIRMLGDKIKLAQTFQVLSTFMFVLMLLSLTYRPLLPSSQDTPSKRGVRTLHQRFLAQLRKYFNMRVFRQRTYRIWAFGIAAAALGYFVPYVHLMKYVEEEFSEIKETWVLLVCIGATSGLGRLVSGHISDSIPGLKKIYLQVLSFLLLGLMSMMIPLCRDFGGLIVVCLFLGLCDGFFITIMAPIAFELVGPMQASQAIGYLLGMMALPMIAGPPIAGLLRNCFGDYHVAFYFAGVPPIIGAVILFFVPLMHQRMFKKEQRDSSKDKMLAPDPDPNGELLPGSPNPEEPI

SEQ ID NO: 228 - protein, 565 aa, Mus musculus
MALPSPASEEAEGPCQEANQEYQEPVCSPVPEPEPEPEPEPEPDPEPVPVPPPEPQPEPEPQPLPDPAPLPELGFEAEPEPQPLPDPAPLPELGFEAEPVQEPEPTPTVETRGTARGFQPPEGGFGWIVVFAATWCNGSIFGIHNSVGILYSMLLEEEKEKNRQVEFQAAWVGALAMGMIFFCSPIVSIFTDRLGCRITATTGAAVAFIGLHTSSFTSSLSLRYFTYGILFGCGCSFAFQPSLVILDHYFQRRLGLANGVVSAGSSIFSMSFPFLIKMLGDKIKLAQTFQVLSTFMFVLTLLSLTYRPLLPSSQDTPSKRGAHTLRQRFLVQFRKYFNMRVFRQRTYRIWAFGIAAAALGYFVPYVHLMKYVEDKFKEIKETWVLLVCIGATSGLGRLVSGHISDSIPGLKKIYLQVLSFLLLGLMSMMIPLCRDFGGLIVVCLFLGLCDGFFITIMAPIAFELVGPMQASQAIGYLLGMMALPMIAGPPIAGLLRNCFGDYHVAFYFAGVPPIIGAVILFFVPLMHQRMFKKEQRDSSKDKMLSHDPDPNGELLPGSPTPEEPI

SEQ ID NO: 229 - protein, 201 aa, Homo sapiens
MKHVNERFQDEKNKEVVLMCIGVTSGVGRLLFGRIADYVPGVKKVYLQVLSFFFIGLMSMMIPLCSIFGALIAVCLIMGLFDGCFISIMAPIAFELVGAQDVSQAIGFLLGFMSIPMTVGPPIAGLLRDKLGSYDVAFYLAGVPPLIGGAVLCFIPWIHSKKQREISKTTGKEKMEKMLENQNSLLSSSSGMFKKESDSII

SEQ ID NO: 230 - protein, 201 aa, Homo sapiens
MKHVNERFQDEKNKEVVLMCIGVTSGVGRLLFGRIADYVPGVKKVYLQVLSFFFIGLMSMMIPLCSIFGALIAVCLIMGLFDGCFISIMAPIAFELVGAQDVSQAIGLLLGFMSIPMTVGPPIAGLLRDKLGSYDVAFYLAGVPPLIGGAVLCFIPWIHSKKQREISKTTGKEKMEKMLENQNSLLSSSSGMFEKESDSII

SEQ ID NO: 231 - protein, 488 aa, Artificial Sequence
  Description of Artificial Sequence: sugar_tr domain consensus sequence
VALVAALGGGFLFGYDTGVIGGFLALIDFLFRFGLLTSSGALAELVGYSTVLTGLVVSIFFLGRLIGSLFAGKLGDRFGRKKSLLIALVLFVIGALLSGAAPGYTTIGLWAFYLLIVGRVLVGLGVGGASVLVPMYISEIAPKALRGALGSLYQLAITIGILVAAIIGLGLNKTNNDSALNSWGWRIPLGLQLVPALLLLIGLLFLPESPRWLVEKGKLEEAREVLAKLRGVEDVDQEIQEIKAELEATVSEEKAGKASWGELFRGRTRPKVRQRLLMGVMLQAFQQLTGINAIFYYSPTIFKSVGVSDSVASLLVTIIVGVVNFVFTFVALIFLVDRFGRRPLLLLGAAGMAICFLILGASIGVALLLLNKPKDPSSKAAGIVAIVFILLFIAFFALGWGPIPWVILSELFPTKVRSKALALATAANWLANFIIGFLFPYITGAIGLALGGYVFLVFAGLLVLFILFVFFFVPETKGRTLEEIEELF

SEQ ID NO: 232 - protein, 307 aa, Homo sapiens; identical to SEQ ID NO: 62

SEQ ID NO: 233 - protein, 308 aa, Mus musculus
MSNQTSVTEFLLLGVTDIQELNPILFVIFFTIYFVNITGNGAILMIVILDPRLHSPMYFFLGNLACLDICFSTVTLPKMLQNLLSTNKAISFLGCITQLHFFHFLGSTEAMLLPVMAFDRFVAICRPLHYSVIMNHQLCIHMTVTIWTLGFFHALLHSVMTSRLSFCGPNHVHHFFCDIKPLLDLACGNTELNLWLLNTVTGTIALTPFFLTFLSYFYIITYLFLKTRSCSMLHKALSTCASHFMVVILLYVPVLFTYIRPASGSSLDQDRIIAIMYSVVTPALNPLIYTLRNKEVRSALNRKVRRWL

SEQ ID NO: 234 - protein, 313 aa, Mus musculus
MLNQTSVTEFILLGVRDIQEPQPFLFAIFFTIYFVNITGNGAILMIVILDPRLHSPMYFFLGNLACLDISYSTVTVPKMLENLLSTNKAISLLGCITQLHFFHFLGTTESLLLAVMAFDRFVAICRPLHYSVIMNWQVCILMAVTIWTIAFLHALLHSVMTSRLSFCGLNHIHHFFCDVKPLLELACGNTELNLWLLNTVTGTIASVPFFLTFLSYFYIITYLFLKTRSCSMLHKALSTCASHFMVVVLFYAPVLFTYIRPTSGSSLDQDRIIAIMYSVVTPALNPLIYTLRNKEVRSALNRKVRRCLLLEEI

SEQ ID NO: 235 - protein, 308 aa, Mus musculus
MSNQTSVTEFLLLGVTDIQELNPILFVIFFTIYFINITGNGAILMIVILDPRLHSPMYFFLGNLACLDISYSTVTVPKLLQNLLSTSKAISFLGCITQLHFFHFLGSTETMLLPVMAFDRFVAICRPLHYSVIMNHQLCIHMTVTIWTLGFFHALLHSVMTSRLSFCGPNHVHHFFCDIKPLLDLACGNTELNLWLLNTVTGTIALTSFFLIFLSYFYIITNLLLKTRSCSMLHKALSTCASHFMVVVLFYAPVLFTYIRPASGSSLDQDTIIAIMYSVVTPALNPLIYTLRNKEVRSALNRKVRRWL

SEQ ID NO: 236 - protein, 277 aa, Mus musculus
MYFVNVAGNGAILMIVISDPRLHLPMYFFLGNLACLDICFSTVTVPKMLENFFSTSKAISFLGCITQLHFFNFLGSTEALLLTVMAFDRFVAICRPLHYPAIMNSQVCIQVAISIWAIPFLHALVHSILTSQLNFCGSNHIHHFFCDVKPLLELACGNTELNRWLLNTLTGTVAIGLFFLTFLSYFYIVTYLFLKTRSCSMLHKALSTCASHFMVVMIFYAPVLFIYINPDSGSSLEKDRIIAVMYTVVTPALNPLIYTLRNKEVRGALNRKIRILL

SEQ ID NO: 237 - protein, 259 aa, Artificial Sequence; identical to SEQ ID NO: 225
  Description of Artificial Sequence: 7tm_1 domain consensus sequence

SEQ ID NO: 238 - DNA, 27 bp, Artificial Sequence
  Description of Artificial Sequence: PCR primer sequence
atgaatattataaaaaccatgcgggaa

SEQ ID NO: 239 - protein, 622 aa, Homo sapiens
MREQLKGHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGHNVGSLFHMADDLGRAMESLVSVMTDEEGAE

SEQ ID NO: 240 - protein, 885 aa, Homo sapiens
EASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLQELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTM

SEQ ID NO: 241 - protein, 885 aa, Homo sapiens; identical to SEQ ID NO: 240

SEQ ID NO: 242 - DNA, 22 bp, Artificial Sequence
  Description of Artificial Sequence: PCR Primer sequence
atcaggacagctgcaggtgggt

SEQ ID NO: 243 - DNA, 27 bp, Artificial Sequence
  Description of Artificial Sequence: PCR Primer sequence
tctcctgtatggactcagaagaaggtg

SEQ ID NO: 244 - protein, 343 aa, Homo sapiens
MAGNCSWEAHPGNRNKMCPGLSEAPELYSRGFLTIEQIAMLPPPAVMNYIFLLLCLCGLVGNGLVLWFFGFSIKRNPFSIYFLHLASADVGYLFSKAVFSILNTGGFLGTFADYIRSVCRVLGLCMFLTGVSLLPAVSAERCASVIFPAWYWRRRPKRLSAVVCALLWVLSLLVTCLHNYFCVFLGRGAPGAACRHMDIFLGILLFLLCCPLMVLPCLALILHVECRARRRQRSAKLNHVILAMVSVFLVSSIYLGIDWFLFWVFQIPAPFPEYVTDLCICINSSAKPIVYFLAGRDKSQRLWEPLRVVFQRALRDGAELGEAGGSTPNTVTMEMQCPPGNAS

SEQ ID NO: 245 - protein, 343 aa, Homo sapiens
MAGNCSWEAHPGNRNRMCPGLSEAPELYSRGFLTIEQIAMLPPPAVMNYIFLLLCLCGLVGNGLVLWFFGFSIKRNPFSIYFLHLASADVGYLFSKAVFSILNTGGFLGTFADYIRSVCRVLGLCMFLTGVSLLPAVSAERCASVIFPAWYWRRRPKRLSAVVCALLWVLSLLVTCLHNYFCVFLGRGAPGAACRHMDIFLGILLFLLCCPLMVLPCLALILHVECRARRRQRSAKLNHVILAMVSVFLVSSIYLGIDWFLFWVFQIPAPFPEYVTDLCICINSSAKPIVYFLAGRDKSQRLWEPLRVVFQRALRDGAELGEAGGSTPNTVTMEMQCPPGNAS

SEQ ID NO: 246 - protein, 342 aa, Homo sapiens
AGNCSWEAHSTNQNKMCPGMSEALELYSRGFLTIEQIATLPPPAVTNYIFLLLCLCGLVGNGLVLWFFGFSIKRTPFSIYFLHLASADGIYLFSKAVIALLNMGTFLGSFPDYVRRVSRIVGLCTFFAGVSLLPAISIERCVSVIFPMWYWRRRPKRLSAGVCALLWLLSFLVTSIHNYFCMFLGHEASGTACLNMDISLGILLFFLFCPLMVLPCLALILHVECRARRRQRSAKLNHVVLAIVSVFLVSSIYLGIDWFLFWVFQIPAPFPEYVTDLCICINSSAKPIVYFLAGRDKSQRLWEPLRVVFQRALRDGAEPGDAASSTPNTVTMEMQCPSGNAS

SEQ ID NO: 247 - protein, 319 aa, Mus musculus
RELYSRGFLTIEQIATLPPPAVTNYIFLLLCLCGLVGNGLVLWFFGFSIKRTPFSIYFLHLASADGMYLFSKAVIALLNMGTFLGSFPDYIRRVSRIVGLCTFFTGVSLLPAISIERCVSVIFPTWYWRRRPKRLSAGVCALLWMLSFLVTSIHNYFCMFLGHEAPGTVCRNMDIALGILLFFLFCPLMVLPCLALILHVECRARRRQRSAKLNHVVLAIVSVFLVSSIYLGIDWFLFWVFQIPAPFPEYVTDLCICINSSAKPIVYFLAGRDKSQRLWEPLRVVFQRALRDGAEPGDAASSTPNTVTMEMQCPSGNAS

SEQ ID NO: 248 - protein, 254 aa, Artificial Sequence
  Description of Artificial Sequence: 7tm_1, 7 transmembrane receptor domain
GNLLVILVILRTKKLRTPTNIFLLNLAVADLLFLLTLPPWALYYLVGGDWVFGDALCKLVGALFVVNGYASILLLTAISIDRYLAIVHPLRYRRIRTPRRAKVLILLVWVLALLLSLPPLLFSWLRTVEEGNTTVCLIDFPEESVKRSYVLLSTLVGFVLPLLVILVCYTRILRTLRKRARSQRSLKRRSSSERKAAKMLLVVVVVFVLCWLPYHIVLLLDSLCLLSIWRVLPTALLITLWLAYVNSCLNPIIY

SEQ ID NO: 249 - DNA, 18 bp, Artificial Sequence
  Description of Artificial Sequence: PCR Primer sequence
ccatgggccgaccggctc

SEQ ID NO: 250 - DNA, 20 bp, Artificial Sequence
  Description of Artificial Sequence: PCR Primer sequence
tggcgggcttcctcgtcatc

SEQ ID NO: 251 - protein, 2109 aa, Homo sapiens
MDALESLLDEVALEGLDGLCLPALWSRLETRVPPFPLPLEPCTQEFLWRALATHPGISFYEEPRERPDLQLQDRYEEIDLETGILESRRDPVALEDVYPIHMILENKDGIQGSCRYFKERKNITNDIRTKSLQPRCTMVEPFDRWGKKLIIGSLPAHAVQALDSPGGGSRPEAARLLLLHPGTARPVQVQGELQRDLHTTAFKVDAGKLHYHRKILNKNGLITMQSHVIRLPTGAQQHSILLLLNRFHVDRRSKYDILMEKLSVMLSTRTNHIETLGKLREELGLCERTFKRLYQYMLNAGLAKVVSLRLQEIHPECGPCKTKKGTDVMVRCLKLLKEFKRNDHDDDEDEEVISKTVPPVDIVFERDMLTQTYDLIERRGTKGISQAEIRVAMNVGKLEARMLCRLLQRFKVVKGFMEDEGRQRTTKYISCVFAEESDLSRQYQREKARSELLTTVSLASMQEESLLPEGEDTFLSESDSEEERSSSKRRGRGSQKDTRASANLRPKTQPHHSTPTKGGWKVVNLHPLKKQPPSFPGAAEERACQSLASRDSLLDTSSVSEPNVSFVSHCADSNSGDIAVIEEVRMENPKESSSSLKTGRHSSGQDKPHETYRLLKRRNLIIEAVTNLRLIESLFTIQKMIMDQEKQEGVSTKCCKKSIVRLVRNLSEEGLLRLYRTTVIQDGIKKKVDLVVHPSMDQNDPLVRSAIEQVRFRISNSSTANRVKTSQPPVPQGEAEEDSQGKEGPSGSGDSQLSASSRSESGRMKKSDNKMGITPLRNYHPIVVPGLGRSLGFLPKMPRLRVVHMFLWYLIYGHPASNTVEKPSFISERRTIKQESGRAGVRPSSSGSAWEACSEAPSKGSQDGVTWEAEVELATETVYVDDASWMRYIPPIPVHRDFGFGWALVSDILLCLPLSIFIQIVQVSYKVDNLEEFLNDPLKKHTLIRFLPRPIRQQLLYKRRYIFSVVENLQRLCYMGVLQFGPTEKFQDKDQVFIFLKKNAVIVDTTICDPHYNLGRRRRPFERRLYVLNSMQDVENYWFDLQCVCLNTPLGVVRCPRVRKNSSTDQGSDEEGSLQKEQESAMDKHNLERKCAMLEYTTGSREVVDEGLIPGDGLGAAGLDSSFYGHLKRNWIWTSYIINQAKKENTAAENGLTVRLQTFLSKRPMPLSARGNSRLNIWGEARVGSELCAGWEEQFEVDREPSLDRNRRVRGGKSQKRKRLKKDPGKKIKRKKKGEFPGEKSKRLRYHDEADQSALHRMTRLRVTWSMQEDGLLVLCRIASNVLNTKVKGPFVTWQVVRDILHATFEESLDKTSHSLGRRARYIVKNPQAYLNYKVCLAEVYQDKALVGDFMNRRGDYDDPKVCANEFKEFVEKLKEKFSSALRNSNLEIPDTLQELFARYRVLAIGDEKDQTRKEDELNSVDDIHFLVLQNLIQSTLALSDSQMKSYQSFQTFRLYREYKDHVLVKAFMECQKRSLVNRRRVNHTLGPKKNRALPFVPMSYQLSQTYYRIFTWRFPSTICTESFQFLDRMRAAGKLDQPDRFSFKDQDNNEPTNDMVAFSLDGPGGNCVAVLTLFSLGLISVDVRIPEQIIVVDSSMVENEVIKSLGKDGSLEDDEDEEDDLDEGVGGKRRSMEVKPAQASHTNYLLMRGYYSPGIVSTRNLNPNDSIVVNSCQMKFQLRCTPVPARLRPAAAPLEELTMGTSCLPDTFTKLINPQENTCSLEEFVLQLELSGYSPEDLTAALEILEAIIATGCFGIDKEELRRRFSALEKAGGGRTRTFADCIQALLEQHQVLEVGGNTARLVAMGSAWPWLLHSVRLKDREDADIQREDPQARPLEGSSSEDSPPEGQAPPSHSPRGTKRRASWASENGETDAEGTQMTPAKRPALQDSNLAPSLGPGAEDGAEAQAPSPPPALEDTAAAGAAQEDQEGVGEFSSPGQEQLSGQAQPPEGSEDPRGFTESFGAANISQAARERDCESVCFIGRPWRVVDGHLNLPVCKGMMEAMLYHIMTRPGIPESSLLRHYQGVLQPVAVLELLQGLESLGCIRKRWLRKPRPVSLFSTPVVEEVEVPSSLDESPMAFYEPTLDCTLRLGRVFPHEVNWNKWIHL

SEQ ID NO: 252 - protein, 1857 aa, Homo sapiens
SKYDILMEKLSVMLSTRTNHIETLGKLREELGLCERTFKRLYQYMLNAGLAKVVSLRLQEIHPECGPCKTKKGTDVMVRCLKLLKEFKRNDHDDDEDEEVISKTVPPVDIVFERDMLTQTYDLIERRGTKGISQAEIRVAMNVGKLEARMLCRLLQRFKVVKGFMEDEGRQRTTKYISCVFAEESDLSRQYQREKARSELLTTVSLASMQEESLLPEGEDTFLSESDSEEERSSSKRRGRGSQKDTRASANLRPKTQPHHSTPTKGGWKVVNLHPLKKQPPSFPGAAEERACQSLASRDSLLDTSSVSEPNVSFVSHCADSNSGDIAVIEEVRMENPKESSSSLKTGRHSSGQDKPHETYRLLKRRNLIIEAVTNLRLIESLFTIQKMIMDQEKQEGVSTKCCKKSIVRLVRNLSEEGLLRLYRTTVIQDGIKKKVDLVVHPSMDQNDPLVRSAIEQVRFRISNSSTANRVKTSQPPVPQGEAEEDSQGKEGPSGSGDSQLSASSRSESGRMKKSDNKMGITPLRNYHPIVVPGLGRSLGFLPKMPRLRVVHMFLWYLIYGHPASNTVEKPSFISERRTIKQESGRAGVRPSSSGSAWEACSEAPSKGSQDGVTWEAEVELATETVYVDDASWMRYIPPIPVHRDFGFGWALVSDILLCLPLSIFIQIVQVSYKVDNLEEFLNDPLKKHTLIRFLPRPIRQQLLYKRRYIFSVVENLQRLCYMGLLQFGPTEKFQDKDQVFIFLKKNAVIVDTTICDPHYNLARSSRPFERRLYVLNSMQDVENYWFDLQCVCLNTPLGVVRCPRVRKNSSTDQGSDEEGSLQKEQESAMDKHNLERKCAMLEYTTGSREVVDEGLIPGDGLGAAGLDSSFYGHLKRNWIWTSYIINQAKKENTAAENGLTVRLQTFLSKRPMPLSARGNSRLNIWGEARVGSELCAGWEEQFEVDREPSLDRNRRVRGGKSQKRKRLKKDPGKKIKRKKKGEFPGEKSKRLRYHDEADQSALQRMTRLRVTWSMQEDGLLVLCRIASNVLNTKVKGPFVTWQVVRDILHATFEESLDKTSHSVGRRARYIVKNPQAYLNYKVCLAEVYQDKALVGDFMNRRGDYDDPKVCANEFKEFVEKLKEKFSSALRNSNLEIPDTLQELFARYRVLAIGDEKDQTRKEDELNSVDDIHFLVLQNLIQSTLALSDSQMKSYQSFQTFRLYREYKDHVLVKAFMECQKRSLVNRRRVNHTLGPKKNRALPFVPMSYQLSQTYYRIFTWRFPSTICTESFQFLDRMRAAGKLDQPDRFSFKDQDNNEPTNDMVAFSLDGPGGNCVAVLTLFSLGLISVDVRIPEQIIVVDSSMVENEVIKSLGKDGSLEDDEDEEDDLDEGVGGKRRSMEVKPAQASHTNYLLMRGYYSPGIVSTRNLNPNDSIVVNSCQMKFQLRCTPVPARLRPAAAPLEELTMGTSCLPDTFTKLINPQENTCSLEEFVLQLELSGYSPEDLTAALEILEAIIATGCFGIDKEELRRRFSALEKAGGGRTRTFADCIQALLEQHQVLEVGGNTARLVAMGSAWPWLLHSVRLKDREDADIQREDPQARPLEGSSSEDSPPEGQAPPSHSPRGTKRRASWASENGETDAEGTQMTPAKRPALQDSNLAPSLGPGAEDGAEAQAPSPPPALEDTAAAGAAQEDQEGVGEFSSPGQEQLSGQAQPPEGSEDPRGFTESFGAANISQAARERDCESVCFIGRPWRVVDGHLNLPVCKGMMEAMLYHIMTRPGIPESSLLRHYQGVLQPVAVLELLQGLESLGCIRKRWLRKPRPVSLFSTPVVEEVEVPSSLDESPMAFYEPTLDCTLRLGRVFPHEVNWNKWIHL

SEQ ID NO: 253 - protein, 2098 aa, Rattus norvegicus
LVTHPGISFYEEPRERPDLQLQDRYEEIDLETGILESRRDPVTLEDVYPIHMILENKDGIQGSCRYFKERKDITSSIRSKCLQPRCTMVEAFSRWGKKLIIVASQDMRYRALIGLEGDPDLKLPDFSYCILERLGRSRWQGELQRDLHTTAFKVDAGKLHYHRKILNKNGLITMQSHVIRLPTGAQQHSILLLLNRFHVDRRSKYDILMEKLSMMLSTRSNQIETLGKLREELGLCERTFKRLYQYMLNAGLAKVVSLPLQEIHPECGPCKTKKGTDVMVRCLKLLKEFRRKMEDDHDDDDDEEAISKAVPPVDIVFERDMLTQTYELIERRGTKGISQAEIRVAMNVGKLEARMLCRLLQRFKVVKGFMEDEGRQRTTKYISCVFAEESDLSRQYAREKARGELLTTVSLASVQDESLMPEGEEAFLSDSESEEESSCSGKRRGRGSRGHSRASGDAGPGSRPHHSTPAKGGWKVLNLHPLKKPKSAAVERSRRSSACRDGLDTSSSSELNIPFDPHSMDSHSGDIAVIEEVRLDNPKEGGGSQKGGRHGSGQDKPHKTYRLLKRRNLIIEAVTNLRLIESLFTIQKMIMDQEKQEGVSTKCCKKSIIRLVRNLSEEGLLRLYRTTVIQDGIKKKVDLVVHPSMDQNDPLVRSAIEQVRFRISNSSTANRVKVPPAPAPQEEAEEGNQEPEVPSRSADSEANTSSKPESTRVKKTDEKMGITPLKNYKPVIVPGLGRSIGFLPKMPRLRVMHLFLWYLVYGHPASHTGEQPTFHSERKTGKQEPSRPGVQPSSGDDWDSSEAKNSTESSSWEAEMELSTERVYVDEISWMRYVPPIPIHRDFGFGWALVSDILLCLPLSIFVQVVQVSYKVDNLEDFLNDPLKKHTLIRFLPRHIRQQLLYKRRYIFSVVENLQRLCYMGLLQFGPTEKFQDKDQVFVFLKKNAVIVDTTICDPHYNLAHSSRPFERRLYVLDSMQDVESYWFDLQCICLNTPLGVVRCPCAQKICPDPGSDPEGSLRKEQESAMDKHNLERKCAMLEYTTGSREVVDEGLVPGDGLGAAGLDSSFYAHLKRNWVWTSYIINKARKNNTSENGLTGRLQTFLSKRPMPLGSGGSGRLPLWSEGKADAELCADKEEHFELDREPTPGRNRKVRGGKSQKRKRLKKEPIRKTKRRRRGEHPEAKSKKLRYQDEADQNALRMMTRLRVSWSMQEDGLLMLCRIASNVLNTKVKGPFVTWQVVRDILHATFEESLDKTSHSVGRRARYIVKNPQAFMNYKVCLAEVYQDKALVGDFMSRKDNYEDPKVCAKEFKEFVEKLKEKFSSGLRNPNLEIPDTLQELFAKYRVLAIGDEKDRVRKEDELNSVEDIHFLVLQNLIQSTLSLSNSQSNSCQSFQIFRLYREFREPVLVRAFMECQKRSLVNRRRVSHSQGPKKNRAVPFVPMSYQLSQSYYKLFTWRFPTTVCTESFQFYDRLRANGILDQPDHFSFKDMDSNDPSSDLVAFSLDSPGGHCVTALALFSLGLLSVDVRIPEQIVVVDSSMVESEVMKSLGKDGGLDDDDEEEDLDEGSGTKRQSVEVKAHQASHTKYLLMRGYYTVPGMVSTRNLNPNDSIVVNSCQVKFRLRNTPAPTHLGPTGPTATPLEELQAGPSCLPASFTSLVDPQLHTRCPEEFAHQMAQSGYSPEDVAASLEILQAVAAADCFGVDREKLSRQFSALEKIADKRTRTFLDYIQDLLEQQQVMEVGGNTVRLVAMASAQPWLLPSVRLKDVEIDTKASGDDSQSRLPAGSSIEDHTSEGAPIPPVSSNGTKKRPYCSIQSPETDAEEATRLPAKKPTLQDVCVAASPRPGTEEQTEAQAQFAAPEDAGAEGPRQESQESVGVSGLEQLGCEFQLPENSEDPRGLTESNMAQVAWESGCERVCFVGRPWRGVDGRLNMPVCKGMMEAVLYHIMSRPGVPESCLLQYYQGVLQPVAVLELLRGLESLGCIQKRMLKKPASVSLFSRPVVEGLGQASEAEALSCQGSTVTFYEPTLDCTIRLGRVFPHDINWKQSGSIYRCVPGQQRSLCPCLIVPPGLSQEPRPSHSCYQSSAQPSTGVATSR

SEQ ID NO: 254 - protein, 660 aa, Homo sapiens
NSLQDRYEEIDLETGILESRRDPVALEDVYPIHMILENKDGIQGSCRYFKERKNITNDIRTKSLQPRCTMVEAFDRWGKKLIIVASQAMRYRALIGQEGDPDLKLPDFSYCILERLGRSRWQGELQRDLHTTAFKVDAGKLHYHRKILNKNGLITMQSHVIRLPTGAQQHSILLLLNRFHVDRRSKYDILMEKLSVMLSTRTNHIETLGKLREELGLCERTFKRLYQYMLNAGLAKVVSLRLQEIHPECGPCKTKKGTDVMVRCLKLLKEFKRNDHDDDEDEEVISKTVPPVDIVFERDMLTQTYDLIERRGTKGISQAEIRVAMNVGKLEARMLCRLLQRFKVVKGFMEDEGRQRTTKYISCVFAEESDLSRQYQREKARSELLTTVSLASMQEESLLPEGEDTFLSESDSEEERSSSKRRGRGSQKDTRASANLRPKTQPHHSTPTKGGWKVVNLHPLKKQPPSFPGAAEERACQSLASRDSLLDTSSVSEPNVSFVSHCADSNSGDIAVIEEVRMENPKESSSSLKTGRHSSGQDKPHETYRLLKRRNLIIEAVTNLRLIESLFTIQKMIMDQEKQEGVSTKCCKKSIVRLVRNLSEEGLLRLYRTTVIQDGIKKKVDLVVHPSMDQNDPLVRSAIEQVRFRISNSSTANRVKTSQP

SEQ ID NO: 255 - protein, 654 aa, Homo sapiens
LQDRYEEIDLETGILESRRDPVALEDVYPIHMILENKDGIQGSCRYFKERKNITNDIRTKSLQPRCTMVEAFDRWGKKLIIVASQAMRYRALIGQEGDPDLKLPDFSYCILERLGRSRWQGELQRDLHTTAFKVDAGKLHYHRKILNKNGLITMQSHVIRLPTGAQQHSILLLLNRFHVDRRSKYDILMEKLSVMLSTRTNHIETLGKLREELGLCERTFKRLYQYMLNAGLAKVVSLRLQEIHPECGPCKTKKGTDVMVRCLKLLKEFKRNDHDDDEDEEVISKTVPPVDIVFERDMLTQTYDLIERRGTKGISQAEIRVAMNVGKLEARMLCRLLQRFKVVKGFMEDEGRQRTTKYISCVFAEESDLSRQYQREKARSELLTTVSLASMQEESLLPEGEDTFLSESDSEEERSSSKRRGRGSQKDTRASANLRPKTQPHHSTPTKGGWKVVNLHPLKKQPPSFPGAAEERACQSLASRDSLLDTSSVSEPNVSFVSHCADSNSGDIAVIEEVRMENPKESSSSLKTGRHSSGQDKPHETYRLLKRRNLIIEAVTNLRLIESLFTIQKMIMDQEKQEGVSTKCCKKSIVRLVRNLSEEGLLRLYRTTVIQDGIKKKVDLVVHPSMDQNDPLVRSAIEQVRFRISNSSTANRVK

SEQ ID NO: 256 - protein, 151 aa, Homo sapiens
MANLERTFIAIKPDGVQRGLVGEIIKRFEQKGFRLVAMKFLRASEEHLKQHYIDLKDRPFFPGLVKYMNSGPVVAMVEGLNVVKTGRVMLGETNPADSKPGTIRGDFCIQVGRNIIHGSDSVKSAEKEISLWFKPEELVDYKSCAHDWVYE

SEQ ID NO: 257 - protein, 151 aa, Rattus norvegicus
MANLERTFIAIKPDGVQRGLVGEIIKRFEQKGFRLVAMKFLRASEEHLKQHYIDLKDRPFFPGLVKYMNSGPVVAMVEGLNVVKTGRVMLGETNPADSKPGTIRGDFCIQVGRNIIHGSDSVESAEKEIGLWFKPEELIDYKSCAHDWVYE

SEQ ID NO: 258 - protein, 151 aa, Mus musculus
MANLERTFIAIKPDGVQRGLVGEIIKRFEQKGFRLVAMKFLRASEEHLKQHYIDLKDRPFFPGLVKYMNSGPVVAMVEGLNVVKTGRVMLGETNPADSKPGTIRGDFCIQVGRNIIHGSDSVESAEKEIHLWFKPEELIDYKSCAHDWVYE

SEQ ID NO: 259 - protein, 152 aa, Gallus gallus
MAANCERTFIAIKPDGVQRGLVGEIIKRFEQKGFRLVAMKFVHASEDLLKQHYIDLKDRPFYPGLVKYMNSGPVVAMWEGLNVVKTGRVMLGETNPADSKPGTIRGDFCIQVGRNIIHGSDSVESAQKEISLWFKPAELIDYRSCAHDWVYE

SEQ ID NO: 260 - protein, 151 aa, Mus musculus
MANSERTFIAIKPDGVQRGLVGEIIKRFEQKGFRLVGLKFLQASEDLLKEHYTDLKDRPFFTGLVKYMHSGPVVAMVEGLNVVKTGRVMLGETNPADSKPGTIRGDFCIQVGRNIIHGSDSVKSAEKEISLWFQPEELVEYKSCAQNWIYE

SEQ ID NO: 261 - protein, 301 aa, Homo sapiens; identical to SEQ ID NO: 124

SEQ ID NO: 262 - protein, 281 aa, Mus musculus; identical to SEQ ID NO: 125

SEQ ID NO: 263 - protein, 307 aa, Rattus norvegicus
MVQLQVFISGLLLLLPGSVDSYEVVKGVVGHPVTIPCTYSTRGGITTTCWGRGQCPYSSCQNILIWTNGYQVTYRSSGRYNIKGRISEGDVSLTIENSVDSDSGLYCCRVEIPGWFNDQKMTFSLEVKPEIPTSPPTRPTTTRPTTTRPTTISTRSTHVPTSTRVSTSTPTPEQTQTHKPEITTFYAHETTAEVTETPSYTPADWNGTVTSSEEAWNNHTVRIPLRKPQRNPTKGFYVGMSVAALLLLLLASTVVVTRYIIIRKKMGSLSFVAFHVSKSRALQNAAIVHPRAEDNIYIIEDRSRGAE

SEQ ID NO: 264 - protein, 305 aa, Mus musculus; identical to SEQ ID NO: 126

SEQ ID NO: 265 - protein, 359 aa, Hepatitis A virus
MHPQVVILSLILHLADSVAGSVKVGGEAGPSVTLPCHYSGAVTSMCWNRGSCSLFTCQNGIVWTNGTHVTYRKDTRYKLLGDLSRRDVSLTIENTAVSDSGVYCCRVEHRGWFNDMKITVSLEIVPPKVTTTPIVTTVPTVTTVRTSTTVPTTTTVPTTTVPTTMSIPTTTTVPTTMTVSTTTSVPTTTSIPTTTSVPVTTTVSTFVPPMPLPRQNHEPVATSPSSPQPAETHPTTLQGAIRREPTSSPLYSYTTDGNDTVTESSDGLWNNNQTQLFLEHSLLTANTTKGIYAGVCISVLVLLALLGVIIAKKYFFKKEVQQLSVSFSSLQIKALQNAVEKEVQAEDNIYIENSLYATD

SEQ ID NO: 266 - DNA, 21 bp, Artificial Sequence
  Description of Artificial Sequence: PCR Primer sequence
catggccttcacagacctgct

SEQ ID NO: 267 - DNA, 22 bp, Artificial Sequence
  Description of Artificial Sequence: PCR Primer sequence
caggttccaggcagcttagatg

SEQ ID NO: 268 - protein, 487 aa, Homo sapiens
MSAVLTPGLFLPLPGPLPASLHKAGGTGPQVRPMAMAFTDLLDALGSMGRFQLNHTALLLLPCGLLACHNFLQNFTAAVPPHHCRGPANHTEASTNDSGAWLRATIPLDQLGAPEPCRRFTKPQWALLSPNSSIPGAATEGCKDGWVYNRSVFPSTIVMEVRRGWVCGGAAAEAQSEAPMSSLQWDLVCEARTLRDLAQSVYIAGVLVGAAVFGSLADRLGCKGPLVWSYLQLAASGAATAYFSSFSAYCVFRFLMGMTFSGIILNSVSLPPARVLDLGDLGSRVVVALLAVVVEWMPTRGRTVAGILLGYSFTLGQLILAGVAYLIRPWRCLQFAISAPFLIFFLYSWWLPESSRWLLLHGKSQLAVQNLQKVAAMNGRKQEGERLTKEVMSSYIQSEFASVCTSNSILDLFRTPAIRKVTCCLMVIWWGHSPMEPTRPAQSCPGNRRFGSRTPGLANRTRKIGAMSKCFASLPAGSRAGLAPGIN

SEQ ID NO: 269 - protein, 347 aa, Homo sapiens
MAFNDLLQQVGGVGRFQQIQVTLVVLPLLLMASHNTLQNFTAAIPTHHCRPPADANLSKNGGLEVWLPRDRQGQPESCLRFTSPQWGLPFLNGTEANGTGATEPCTDGWIYDNSTFPSTIVTEWDLVCSHRALRQLAQSLYMVGVLLGAMVFGYLADRLGRRKVLILNYLQTAVSGTCAAFAPNFPIYCAFRLLSGMALAGISLNCMTLNVEWMPIHTRACVGTLIGYVYSLGQFLLAGVAYAVPHWRHLQLLVSAPFFAFFIYSWFFIESARWHSSSGRLDLTLRALQRVARINGKREEGAKLSMEVLRASLQKELTMGKGQASAMELLRCPTLRHLFLCLSMLWF

SEQ ID NO: 270 - protein, 347 aa, Homo sapiens; identical to SEQ ID NO: 269

SEQ ID NO: 271 - protein, 347 aa, Homo sapiens; identical to SEQ ID NO: 269

SEQ ID NO: 272 - protein, 359 aa, Pseudopleuronectes americanus
MPFSELLEQVGSTGRFQVLHVTLLCIPVLMMASHNLLQNFVATVPSHYCNAHANLSQARLSLEESLLITVPLDGAGKPQRCQRYAAPQWHLLGKNGTSGSGDLADATESMDAALQECSDGWSYNSTVRSSTIISEWHLVCDMHSFKQMGQTIYMGGVLVGALLFGGLSDRYGRRILLLISNLLMAVSGTCAAFSSSFSLFCVFRFGCGLALSGLGLNTFSLIVEWIPTRIRTAVGTTTGYCYTLGQLILVLLAYFIRDWRWLTLAVSLPFYVFFLIAWWFHESSRWLALSNRTEHALKNLKSVARFNGRHEEAEKLDIKMLHESMKKEMSCTQGSYSILDLFNTPAMRKRTLCLSAVWL

SEQ ID NO: 273 - protein, 563 aa, Homo sapiens
MAFNDLLQQVGGVGRFQQIQVTLVVLPLLLMASHNTLQNFTAAIPTHHCRPPADANLSKNGGLEVWLPRDRQGQPESCLRFTSPQWGLPFLNGTEANGTGATEPCTDGWIYDNSTFPSTIVTEWDLVCSHRALRQLAQSLYMVGVLLGAMVFGYLADRLGRRKVLILNYLQTAVSGTCAAFAPNFPIYCAFRLLSGMALAGISLNCMTLNVEWMPIHTRACVGTLIGYVYSLGQFLLAGVAYAVPHWRHLQLLVSAPFFAFFIYSWFFIESARWHSSSGRLDLTLRALQRVARINGKREEGAKLSMEVLRASLQKELTMGKGQASAMELLRCPTLRHLFLCLSMLWFATSFAYYGLVMDLQGFGVSIYLIQVIFGAVDLPAKLVGFLVINSLGRRPAQMAALLLAGICILLNGVIPQDQSIVRTSLAVLGKGCLAASFNCIFLYTGELYPTMIRQTGMGMGSTMARVGSIVSPLVSMTAELYPSMPLFIYGAVPVAASAVTVLLPETLGQPLPDTVQDLESRWAPTQKEAGIYPRKGKQTRQQQEHQKYMVPLQASAQEKNGL

SEQ ID NO: 274 - protein, 550 aa, Homo sapiens [sequence omitted]

SEQ ID NO: 275 - protein, 550 aa, Homo sapiens
MAFNDLLQQVGGVGRFQQIQVTLVVLPLLLMASHNTLQNFTAAIPTHHCRPPADANLSKNGGLEVWLPRDRQGQPESCLRFTSPQWGLPFLNGTEANGTGATEPCTDGWIYDNSTFPSTIVTEWDLVCSHRALRQLAQSLYMVGVLLGAMVFGYLADRLGRRKVLILNYLQTAVSGTCAAFAPNFPIYCAFRLLSGMALAGISLNCMTLNVEWMPIHTRACVGTLIGYVYSLGQFLLAGVAYAVPHWRHLQLLVSAPFFAFFIYSWFFIESARWHSSSGRLDLTLRALQRVARINGKREEGAKLSMEVLRASLQKELTMGKGQASAMELLRCPTLRHLFLCLSMLWFATSFAYYGLVMDLQGFGVSIYLIQVIFGAVDLPAKLVGFLVINSLGRRPAQMAALLLAGICILLNGVIPQDQSIVRTSLAVLGKGCLAASFNCIFLYTGELYPTMIRQTGMGMGSTMARVGSIVSPLVSMTAELYPSMPLFIYGAVPVAASAVTVLLPETLGQPLPDTVQDLESRKGKQTRQQQEHQKYMVPLQASAQEKNGL

SEQ ID NO: 276 - protein, 551 aa, Rattus norvegicus
MAFNDLLKQVGGVGRFQLIQVTMVVAPLLLMASHNTLQNFTAAIPPHHCRPPANANLSKDGGLEAWLPLDKQGQPESCLRFTSPQWGPPFYNGTEANGTRVTEPCIDGWVYDNSTFPSTIVTEWNLVCSHRAFRQLAQSLYMVGVLLGAMVFGYLADRLGRRKVLILNYLQTAVSGTCAAYAPNYTVYCVFRLLSGMSLASIAINCMTLNVEWMPIHTRAYVGTLIGYVYSLGQFLLAGIAYAVPHWRHLQLVVSVPFFIAFIYSWFFIESARWYSSSGRLDLTLRALQRVARINGKQEEGAKLSIEVLRTSLQKELTLSKGQASAMELLRCPTLRHLFLCLSMLWFATSFAYYGLVMDLQGFGVSMYLIQVIFGAVDLPAKFVCFLVINSMGRRPAQMASLLLAGICILVNGIIPKSHTIIRTSLAVLGKGCLASSFNCIFLYTGELYPTVIRQTGLGMGSTMARVGSIVSPLVSMTAEFYPSMPLFIFGAVPVVASAVTALLPETLGQPLPDTVQDLKSRSRGKQNQQQQEQQKQMMPLQASTQEKNGL

SEQ ID NO: 277 - protein, 551 aa, Rattus norvegicus; identical to SEQ ID NO: 276

SEQ ID NO: 278 - DNA, 24 bp, Artificial Sequence
  Description of Artificial Sequence: PCR Primer sequence
gctcgctgtcctgctagtcttgtt

SEQ ID NO: 279 - DNA, 27 bp, Artificial Sequence
  Description of Artificial Sequence: PCR Primer sequence
agaaacataattctccctctggtgagg

SEQ ID NO: 280 - DNA, 24 bp, Artificial Sequence
  Description of Artificial Sequence: PCR Primer sequence
gctcgctgtcctgctagtcttgtt

SEQ ID NO: 281 - DNA, 27 bp, Artificial Sequence
  Description of Artificial Sequence: PCR Primer sequence
agaaacataattctccctctggtgagg

SEQ ID NO: 282 - DNA, 24 bp, Artificial Sequence
  Description of Artificial Sequence: PCR Primer sequence
gctcgctgtcctgctagtcttgtt

SEQ ID NO: 283 - DNA, 27 bp, Artificial Sequence
  Description of Artificial Sequence: PCR Primer sequence
agaaacataattctccctctggtgagg

SEQ ID NO: 284 - DNA, 27 bp, Artificial Sequence
  Description of Artificial Sequence: PCR Primer sequence
gttttgtcagggagttgagaaactgtg

SEQ ID NO: 285 - DNA, 22 bp, Artificial Sequence
  Description of Artificial Sequence: PCR Primer sequence
gaaatggggtgacttccacgac

SEQ ID NO: 286 - protein, 326 aa, Homo sapiens
MELSGATMARGLAVLLVLFLHIKNLPAQAADTCPEVKVVGLEGSDKLTILRGCPGLPGAPGPKGEAGVIGERGERGLPGAPGKAGPVGPKGDRGEKGMRGEKGDAGQSQSCATGPRNCKDLLDRGYFLSGWHTIYLPDCRPLTVLCDMDTDGGGWTVFQRRMDGSVDFYRDWAAYKQGFGSQLGEFWLGNDNIHALTAQGSSELRVDLVDFEGNHQFAKYKSFKVADEAEKYKLVLGAFVGGSAGNSLTGHNNNFFSTKDQDNDVSSSNCAEKFQGAWWYADCHASNLNGLYLMGPHESYANGINWSAAKGYKYSYKVSEMKVRPA

SEQ ID NO: 287 - protein, 326 aa, Homo sapiens [sequence omitted]

SEQ ID NO: 288 - protein, 319 aa, Homo sapiens; identical to SEQ ID NO: 93

SEQ ID NO: 289 - protein, 326 aa, Sus scrofa
MELSRVAVALGPTGQLLLFLSFQTLAAQAADTCPEVKVVGLEGSDKLSILRGCPGLPGAAGPKGEAGANGPKGERGSPGVVGKAGPAGPKGDRGEKGARGEKGEPGQLQSCATGPRTCKELLTRGHFLSGWHTIYLPDCQPLTVLCDMDTDGGGWTVFQRRSDGSVDFYRDWAAYKRGFGSQLGEFWLGNDHIHALTAQGTSELRVDLVDFEGNHQFAKYRSFQVAGEAEKYKLVLGGFLEGNAGDSLSSHRDQFFSTKDQDNDNHSGNCAEQYHGAWWYNACHSSNLNGRYLRGLHTSYANGVNWRSGRGYNYSYQVSEMKVRLT

SEQ ID NO: 290 - protein, 319 aa, Rattus norvegicus
MVLGSAALFVLSLCVTELTLHAADTCPEVKVLDLEGSNKLTILQGCPGLPGALGPKGEAGAKGDRGESGLPGHPGKAGPTGPKGDRGEKGVRGEKGDTGPSQSCATGPRTCKELLTRGYFLTGWYTIYLPDCRPLTVLCDMDTDGGGWTVFQRRIDGTVDFFRDWTSYKQGFGSQLGEFWLGNDNIHALTTQGTNELRVDLADFDGNHDFAKYSSFQIQGEAEKYKLILGNFLGGGAGDSLTSQNNMLFSTKDQDNDQGSSNCAVRYHGAWWYSDCHTSNLNGLYLRGLHKSYANGVNWKSWKGYNYSYKVSEMKVRLI

SEQ ID NO: 291 - DNA, 24 bp, Artificial Sequence
  Description of Artificial Sequence: PCR Primer sequence
gctcgctgtcctgctagtcttgtt

SEQ ID NO: 292 - DNA, 27 bp, Artificial Sequence
  Description of Artificial Sequence: PCR Primer sequence
agaaacataattctccctctggtgagg

SEQ ID NO: 293 - protein, 326 aa, Homo sapiens; identical to SEQ ID NO: 286

SEQ ID NO: 294 - protein, 319 aa, Homo sapiens; identical to SEQ ID NO: 93

SEQ ID NO: 295 - protein, 326 aa, Homo sapiens [sequence omitted]

SEQ ID NO: 296 - protein, 187 aa, Homo sapiens
MELSGATMARGLAVLLVLFLHIKNLPAQAADTCPEVKVVGLEGSDKLTILRGCPGLPGAPGPKGEAGVIGERGERGLPGAPGKAGPVGPKGDAGQSQSCATGPRNCKDLLDRGYFLSGWHTIYLPDCRPLTVLCDMDTDGGGWTVFQRRMDGSVDFYRDWAAYKQGFGSQLGEFWLGNDNIHALTAQ

SEQ ID NO: 297 - protein, 326 aa, Sus scrofa; identical to SEQ ID NO: 289

SEQ ID NO: 298 - protein, 482 aa, Homo sapiens
MRGSPGDAERRQRWGRLFEELDSNKDGRVDVHELRQGLARLGGGNPDPGAQQGISSEGDADPDGGLDLEEFSRYLQEREQRLLLMFHSLDRNQDGHIDVSEIQQSFRALGISISLEQAEKILHSMDRDGTMTIDWQEWRDHFLLHSLENVEDVLYFWKHSTLSSAGFSAWIKDSTAEQNRSKTTVLARRSGSHLKSQHFGRPKWADHEVLDIGECLTVPDEFSKQEKLTGMWWKQLVAGAVAGAVSRTGTAPLDRLKVFMQVHASKTNRLNILGGLRSMVLEGGIRSLWRGNGINVLKIAPESAIKFMAYEQIKRAILGQQETLHVQERFVAGSLAGATAQTIIYPMEVLKTRLTLRRTGQYKGLLDCARRILEREGPRAFYRGYLPNVLGIIPYAGIDLAVYETLKNWWLQQYSHDSADPGILVLLACGTISSTCGQIASYPLALVRTRMQAQGWSTVARFQITATSAFQVQAILLPQPPE

SEQ ID NO: 299 - protein, 384 aa, Homo sapiens
MFHSLDRNQDGHIDVSEIQQSFRALGISISLEQAEKILHSMDRDGTMTIDWQEWRDHFLLHSLENVEDVLYFWKHSTVLDIGECLTVPDEFSKQEKLTGMWWKQLVAGAVAGAVSRTGTAPLDRLKVFMQVHASKTNRLNILGGLRSMVLEGGIRSLWRGNGINVLKIAPESAIKFMAYEQIKRAILGQQETLHVQERFVAGSLAGATAQTIIYPMEVLKTRLTLRRTGQYKGLLDCARRILEREGPRAFYRGYLPNVLGIIPYAGIDLAVYETLKNWWLQQYSHDSADPGILVLLACGTISSTCGQIASYPLALVRTRMQAQASIEGGPQLSMLGLLRHILSQEGMRGLYRGIAPNFMKVIPAVSISYVVYENMKQALGVTSR

SEQ ID NO: 300 - protein, 568 aa, Homo sapiens
SELLLRPGTTAVLAHLKKQETAPACRASSLRTPGQSSQQLCSQRALVLWSHPSKVNSRHRRRLEETVMLQMLWHFLASFFPRAGCHGSREGDDREVRGTPAPAWRDQMASFLGKQDGRAEATEKRPTILLVVGPAEQFPKKIVQAGDKDLDGQLDFEEFVHYLQDHEKKLRLVFKSLDKKNDGRIDAQEIMQSLRDLGVKISEQQAEKILKRIRTGHFWGPVTYMDKNGTMTIDWNEWRDYHLLHPVENIPEIILYWKHSTIFDVGENLTVPDEFTVEERQTGMWWRHLVAGGGAGAVSRTCTAPLDRLKVLMQVHASRSNNMGIVGGFTQMIREGGARSLWRGNGINVLKIAPESAIKFMAYEQIKRLVGSDQETLRIHERLVAGSLAGAIAQSSIYPMEVLKTRMALRKTGQYSGMLDCARRILAREGVAAFYKGYVPNMLGIIPYAGIDLAVYETLKNAWLQHYAVNSADPGVFVLLACGTMSSTCGQLASYPLALVRTRMQAQASIEGAPEVTMSSLFKHILRTEGAFGLYRGLAPNFMKVIPAVSISYVVYENLKITLGVQSR

SEQ ID NO: 301 - protein, 475 aa, Oryctolagus cuniculus
MLRWLRGFVLPTAACQGAEPPTRYETLFQALDRNGDGVVDIRELQEGLKSLGIPLGQDAEEKIFTTGDVNKDGKLDFEEFMKYLKDHEKKMKLAFKSLDKNNDGKIEASEIVQSLQTLGLTISEQQAELILQSIDADGTMTVDWNEWRDYFLFNPVADIEEIIRFWKHSTGIDIGDSLTIPDEFTEEERKSGQWWRQLLAGGIAGAVSRTSTAPLDRLKVMMQVHGSKSMNIFGGFRQMIKEGGVRSLWRGNGTNVIKIAPETAVKFWVYEQYKKLLTEEGQKIGTFERFISGSMAGATAQTFIYPMEVMKTRLAVGKTGQYSGIYDCAKKILKYEGFGAFYKGYVPNLLGIIPYAGIDLAVYELLKSHWLDNFAKDSVNPGVLVLLGCGALSSTCGQLASYPLALVRTRMQAQAMLEGAPQLNMVGLFRRIISKEGLPGLYRGITPNFMKVLPAVGISYVVYENMKQTLGVTQK

SEQ ID NO: 302 - protein, 366 aa, Mus musculus
MQSLRDLGVKISEQQAEKILKSMDKNGTMTIDWNEWRDYHLLHPVENIPEIILYWKHSTIFDVGENLTVPDEFTVEERQTGMWWRHLVAGGGAGAVSRTCTAPLDRLKVLMQVHASRSNNMCIVGGFTQMIREGGAKSLWRGNGINVLKIAPESAIKFMAYEQMKRLVGSDQETLRIHERLVAGSLAGAIAQSSIYPMEVLKTRMALRKTGQYSGMLDCARRILAKEGVAAFYKGYIPNMLGIIPYAGIDLAVYETLKNTWLQRYAVNSADPGVFVLLACGTISSTCGQLASYPLALVRTRMQAQASIEGAPEVTMSSLFKQILRTEGAFGLYRGLAPNFMKVIPAVSISYVVYENLKITLGVQSR

SEQ ID NO: 303 - protein, 597 aa, Oryctolagus cuniculus
MVADNSTSDPHAPGPQLSVTDIVVITVYFALNVAVGIWSSCRASRNTVSGYFLAGRDMTWWPIGASLFGSSEGSGLFIGLAGSGAAGGLAVAGFDWNATYVLLALAWVFGAIYISSEIVTLAEYIQKRFGGQRIRMYLSVLSLLLSVFTKISLDLYAGALFVHICLGWNFYLSTILTLTITALYTITGGLVAVIYTDALQTLIMVVGAVILAIKAFHQIDGYGQMEAAYARAIPSRTVANTTCHLPRADAMHMFRDPYTGDLPWTGMTFGLTIMATWYWCTDQVIVQRSLSARNLNHAKAGSILASYLKMLPMGLMIMPGMISRALFPDEVGCVVPSECLRACGAEIGCSNIAYPKLVMELMPVGLRGLMIAVMMPALMSSLSSIFNSSSTLFTMDIWRRLRPCASERELLLVGRLVIVVLIGVSVAWIPVLQGSNGGQLFIYMQSVTSSLAPPVTAVFTLGIFWQRANEQGAFWGLLAGLAVGATRLVLEFLHPAPPCGAADTRPAVLSQLHYLHFAVALFVLTGAVAVGGSLLTPPPRRHQIENLTWWTLTRDLSLGAKAGDGQTPQRYTFWARVCGFNAILLMCVNIFFYAYFA

SEQ ID NO: 304 - protein, 517 aa, Homo sapiens
MPRTCCWHWHGCSCPSTSPQRSSPYLSTFRSATGASGSACTCLSCPCYCLSSPRYRWTCTRGALFVHICLGWNFYLSTILTLGITALYTIAGGLAAVIYTDALQTLIMVVGAVILTIKAFDQIGGYGQLEAAYAQAIPSRTIANTTCHLPRTDAMHMFRDPHTGDLPWTGMTFGLTIMATWYWCTDQVIVQRSLSARDLNHAKAGSILASYLKMLPMGLIIMPGMISRALFPGAHVYEERHQVSVSRTDDVGCVVPSECLRACGAEVGCSNIAYPKLVMELMPIGLRGLMIAVMLAALMSSLTSIFNSSSTLFTMDIWRRLRPRSGERELLLVGRLVIVALIGVSVAWIPVLQDSNSGQLFIYMQSVTSSLAPPVTAVFVLGVFWRRANEQGAFWGLIAGLVVGATRLVLEFLNPAPPCGEPDTRPAVLGSIHYLHFAVALFALSGAVVVAGSLLTPPPQSVQIENLTWWTLAQDVPLGTKAGDGQTPQKHAFWARVCGFNAILLMCVNIFFYAYFA

SEQ ID NO: 305 - protein, 552 aa, Homo sapiens
MGPGASGDGVRTETAPHIALDSRVGLHAYDISVVVIYFVFVIAVGIWSSIRASRGTIGGYFLAGRSMSWWPIGASLMSSNVGSGLFIGLAGTGAAGGLAVGGFEWNATWLLLALGWVFVPVYIAAGVVTMPQYLKKRFGGQRIQVYMSVLSLILYIFTKISTDIFSGALFIQMALGWNLYLSTGILLVVTAVYTIAGGLMAVIYTDALQTVIMVGGALVLMFLGFQDVGWYPGLEQRYRQAIPNVTVPNTTCHLPRPDAFHILRDPVSGDIPWPGLIFGLTVLATWCWCTDQVIVQRSLSAKSLSHAKGGSVLGGYLKILPMFFIVMPGMISRALFPDEVGCVDPDVCQRICGARVGCSNIAYPKLVMALMPVGLRGLMIAVIMAALMSSLTSIFNSSSTLFTIDVWQRFRRKSTEQELMVVGRVFVVFLVVISILWIPIIQSSNSGQLFDYIQAVTSYLAPPITALFLLAIFCKRVTEPGAFWGLVFGLGVGLLRMILEFSYPAPACGEVDRRPAVLKDFHYLYFAILLCGLTAIVIVIVSLCTTPIPEEQ

SEQ ID NO: 306 - protein, 664 aa, Ovis aries
MDSSTLSPPATDTAEPLQAYERIRNAADISVIVIYFVVVMAVGLWHMFSTNRGTVGGFFLAGRSMVWWPIGASLFASNIGSGHFVGLAGTGAAAGIATGGFEWNALILVVLLGWVFVPIYIKAGVVTMPEYLRKRFGGQRIQVYLSVLSLVLYIFTKISADIFSGAIFINLALGLDLYLAIFILLAITALYTITGGLAAVIYTDTLQTVIMLLGSFILTGFAFHEVGGYSAFVTKYMNAIPTVTSYGNTTVKKECYTPRADSFHIFRDPLKGDLPWPGLIFGLTIISLWYWCTDQVIVQRCLSAKNMSHVKAGCIMCGYMKLLPMFLMVMPGMISRILFTEKVACTVPSECEKYCGTKVGCTNIAYPTLVVELMPNGLRGLMLSVMLASLMSSLTSIFNSASTLFTMDIYTKIRKKASEKELMIAGRLFMLVLIGVSIAWVPIVQSAQSGQLFDYIQSITSYLGPPIAAVFLLAIFCKRVNEPGAFWGLIIGFLIGVSRMITEFAYGTGSCMEPSNCPTIICGVHYLYFAIILFVITIIVILAISLFTKPIADVHLYRLCWSLRNSKEERIDLDAEDEDIQDAREDALEIDTEASEEKKGCLRQAYDMFCGLDQQKGPKMTKEEEAAMKLKMTDTSEKRLWRMVVNINGIILLAVAVFCHAYFA

SEQ ID NO: 307 - protein, 664 aa, Ovis aries
MDSSTWSPPATATAEPLQAYERIRNAADISVIVIYFVVVMAVGLWAMFSTNRGTVGGFFLAGRSMVWWPIGASLFASNIGSGHFVGLAGTGAAAGIATGGFEWNALILVVLLGWVFVPIYIKAGVVTMPEYLRKRFGGQRIQVYLSVLSLVLYIFTKISADIFSGAIFINLALGLDLYLAIFILLAITALYTITGGLAAVIYTDTLQTVIMLLGSFILTGFAFHEVGGYSAFVTKYMNAIPTVTSYGNTTVKKECYTPRADSFHIFRDPLKGDLPWPGLIFGLTIISLWYWCTDQVIVQRCLSAKNMSHVKAGCIMCGYMKLLPMFLMVMPGMISRILFTEKVACTVPSECEKYCGTKVGCTNIAYPTLVVELMPNGLRGLMLSVMLASLMSSLTSIFNSASTLFTMDIYTKIRKKASEKELMIAGRLFMLVLIGVSIAWVPIVQSAQSGQLFDYIQSITSYLGPPIAAVFLLAIFCKRVNEPGAFWGLIIGFLIGVSRMITEFAYGTGSCMEPSNCPTIICGVHYLYFAIILFVITIIVILAISLFTKPIADVHLYRLCWSLRNSKEERIDLDAEDEDIQDAREDALEIDTEASEEKKGCLRQAYDMFCGLDQQKGPKMTKEEEAAMKLKMTDTSEKRLWRMVVNINGIILLAVAVFCHAYFA

SEQ ID NO: 308 - DNA, 24 bp, Artificial Sequence
  Description of Artificial Sequence: PCR Primer sequence
gtcaggactgagacagctccacac

SEQ ID NO: 309 - DNA, 24 bp, Artificial Sequence
  Description of Artificial Sequence: PCR Primer sequence
ctgaagccaggtctgtggaatcac

SEQ ID NO: 310 - DNA, 24 bp, Artificial Sequence
  Description of Artificial Sequence: PCR Primer sequence
gtcaggactgagacagctccacac

SEQ ID NO: 311 - DNA, 24 bp, Artificial Sequence
  Description of Artificial Sequence: PCR Primer sequence
ctgaagccaggtctgtggaatcac

SEQ ID NO: 312 - protein, 527 aa, Homo sapiens
MGPGASGDGVRTETAPHIALDSRVGLHAYDISVVVIYFVFVIAVGIWSSIRASRGTIGGYFLAGRSMSWWPIGASLMSSNVGSGLFIGLAGTGAAGGLAVGGFEWNATWLLLALGWVFVPVYIAAGVVTMPQYLKKRFGGQRIQVYMSVLSLILYIFTKISTDIFSGALFIQMALGWNLYLSTGILLVVTAVYTIAGGLMAVIYTDALQTVIMVGGALVLMFLGFQDVGWYPGLEQRYRQAIPNVTVPNTTCHLPRPDAFHILRDPVSGDIPWPGLIFGLTVLATWCWCTDQVIVQRSLSAKSLSHAKGGSVLGGYLKILPMFFIVMPGMISRALFPDEVGCVDPDVCQRICGARVGCSNIAYPKLVMALMPVGLRGLMIAVIMAALMSSLTSIFNSSSTLFTIDVWQRFRRKSTEQELMVVGRVFVVFLVVISILWIPIIQSSNSGQLFDYIQAVTSYLAPPITALFLLAIFCKRVTEPGAFWGLVFGLGVGLLRMILEFSYPAPACGEVDRRPAVLKDFHYLYFA

SEQ ID NO: 313 - protein, 530 aa, Ovis aries
MDSSTLSPPATDTAEPLQAYERIRNAADISVIVIYFVVVMAVGLWHMFSTNRGTVGGFFLAGRSMVWWPIGASLFASNIGSGHFVGLAGTGAAAGIATGGFEWNALILVVLLGWVFVPIYIKAGVVTMPEYLRKRFGGQRIQVYLSVLSLVLYIFTKISADIFSGAIFINLALGLDLYLAIFILLAITALYTITGGLAAVIYTDTLQTVIMLLGSFILTGFAFHEVGGYSAFVTKYMNAIPTVTSYGNTTVKKECYTPRADSFHIFRDPLKGDLPWPGLIFGLTIISLWYWCTDQVIVQRCLSAKNMSHVKAGCIMCGYMKLLPMFLMVMPGMISRILFTEKVACTVPSECEKYCGTKVGCTNIAYPTLVVELMPNGLRGLMLSVMLASLMSSLTSIFNSASTLFTMDIYTKIRKKASEKELMIAGRLFMLVLIGVSIAWVPIVQSAQSGQLFDYIQSITSYLGPPIAAVFLLAIFCKRVNEPGAFWGLIIGFLIGVSRMITEFAYGTGSCMEPSNCPTIICGVHYLYFA

SEQ ID NO: 314 - protein, 530 aa, Ovis aries
MDSSTWSPPATATAEPLQAYERIRNAADISVIVIYFVVVMAVGLWAMFSTNRGTVGGFFLAGRSMVWWPIGASLFASNIGSGHFVGLAGTGAAAGIATGGFEWNALILVVLLGWVFVPIYIKAGVVTMPEYLRKRFGGQRIQVYLSVLSLVLYIFTKISADIFSGAIFINLALGLDLYLAIFILLAITALYTITGGLAAVIYTDTLQTVIMLLGSFILTGFAFHEVGGYSAFVTKYMNAIPTVTSYGNTTVKKECYTPRADSFHIFRDPLKGDLPWPGLIFGLTIISLWYWCTDQVIVQRCLSAKNMSHVKAGCIMCGYMKLLPMFLMVMPGMISRILFTEKVACTVPSECEKYCGTKVGCTNIAYPTLVVELMPNGLRGLMLSVMLASLMSSLTSIFNSASTLFTMDIYTKIRKKASEKELMIAGRLFMLVLIGVSIAWVPIVQSAQSGQLFDYIQSITSYLGPPIAAVFLLAIFCKRVNEPGAFWGLIIGFLIGVSRMITEFAYGTGSCMEPSNCPTIICGVHYLYFA

SEQ ID NO: 315 - protein, 530 aa, Ovis aries
MDSSTWSPPATATAEPLQAYERIRNAADISVIVIYFVVVMAVGLWAMFSTNRGTVGGFFLAGRSMVWWPIGASLFASNIGSGHFVGLAGTGAAAGIATGGFEWNALILVVLLGWVFVPIYIKAGVVTMPEYLRKRFGGQRIQVYLSVLSLVLYIFTKISADIFSGAIFINLALGLDLYLAIFILLAITALYTITGGLAAVIYTDTLQTVIMLLGSFILTGFAFHEVGGYSAFVRKYMNAIPTVTSYGNTTVKKECYTPRADSFHIFRDPLKGDLPWPGLIFGLTIISLWYWCTDQVIVQRCLSAKNMSHVKAGCIMCGYMKLLPMFLMVMPGMISRILFTEKVACTVPSECEKYCGTKVGCTNIAYPTLVVELMPNGLRGLMLSVMLASLMSSLTSIFNSASTLFTMDIYTKIRKKASEKELMIAGRLFMLVVIGVSIAWVPIVQSAQSGQLFDYIQSITSYLGPPMRAVFLLAIFCKRVNEPGAFWGLIIGFLIGVSRMITEFAYGTGSCMEPSNCPTIICGVHYLYFA

SEQ ID NO: 316 - protein, 530 aa, Mus musculus
MDSSTLSPAVTATDAPIPSYERIRNAADISVIVIYFVVVMAVGLWAMFSTNRGTVGGFFLAGRSMVWWPIGASLFASNIGSGHFVGLAGTGAAAGIAMGGFEWNALVLVVVLGWIFVPIYIKAGVVTMPEYLRKRFGGKRIQIYLSVLSLLLYIFTKISADIFSGAIFINLALGLDIYLAIFILLAITALYTITGGLAAVIYTDTLQTAIMLVGSFILTGFAFNEVGGYEAFMDKYMKAIPTKVSNGNFTAKEECYTPRADSFHIFRDPITGDMPWPGLIFGLAILALWYWCTDQVIVQRCLSAKNMSHVKAGCTLCGYLKLLPMFLMVMPGMISRILYTEKIACVLPEECQKYCGTPVGCTNIAYPTLVVELMPNGLRGLMLSVMMASLMSSLTSIFNSASTLFTMDIYTKIRKKASEKELMIAGRLFILVLIGISIAWVPIVQSAQSGQLFDYIQSITSYLGPPIAAVFLLAIFCKRVNEQGAFWGLILGFLIGISRMITEFAYGTGSCMEPSNCPKIICGVHYLYFA

SEQ ID NO: 317 - protein, 675 aa, Homo sapiens
MESGTSSPQPPQLDPLDAFPQKGLEPGDIAVLVLYFLFVLAVGLWSTVKTKRDTVKGYFLAGGDMVWWPVGASLFASNVGSGHFIGLAGSGAATGISVSAYELNGLFSVLMLAWIFLPIYIAGQVTTMPEYLRKRFGGIRIPIILAVLYLFIYIFTKISVDMYAGAIFIQQSLHLDLYLAIVGLLAITAVYTVAGGLAAVIYTDALQTLIMLIGALTLMGYSFAAVGGMEGLKEKYFLALASNRSENSSCGLPREDAFHIFRDPLTSDLPWPGVLFGMSIPSLWYWCTDQVIVQRTLAAKNLSHAKGGALMAAYLKVLPLFIMVFPGMVSRILFPDQVACADPEICQKICSNPSGCSDIAYPKLVLELLPTGLRGLMMAVMVAALMSSLTSIFNSASTIFTMDLWNHLRPRASEKELMIVGRVFVLLLVLVSILWIPVVQASQGGQLFIYIQSISSYLQPPVAVVFIMGCFWKRTNEKGAFWGLISGLLLGLVRLVLDFIYVQPRCDQPDERPVLVKSIHYLYFSMILSTVTLITVSTVSWFTEPPSKEMVSHLTWFTRHDPVVQKEQAPPAAPLSLTLSQNGMPEASSSSSVQFEMVQENTSKTHSCDMTPKQSKVVKAILWLCGIQEKGKEELPARAEAIIVSLEENPLVKTLLDVNLIFCVSCAIFIWGYFA

SEQ ID NO: 318 - protein, 675 aa, Homo sapiens
MESGTSSPQPPQLDPLDAFPQKGLEPGDIAVLVLYFLFVLTVGLWSTVKTKRDTVKGYFLAGGDMVWWPVGASLFASNVGSGHFIGLAGSGAATGISVSAYELNGLFSVLMLAWIFLPIYIAGQVTTMPEYLRKRFGGIRIPIILAVLYLFIYIFTKISVDMYAGAIFIQQSLHLDLYLAIAGLLAITAVYTVAGGLAAVIYTDALQTLIMLIGALTLMGYSFAAVGGMEGLKEKYFLALASNRSENSSCGLPREDAFHIFRDPLTSDLPWPGVLFGMSIPSLWYWCTDQVIVQRTLAAKNLSHAKGGALMAAYLKVLPLFIMVFPGMVSRILFPDQVACADPEICQKICSNPSGCSDIAYPKLVLELLPTGLRGLMMAVMVAALMSSLTSIFNSASTIFTMDLWNHLRPRASEKELMIVGRVFVLLLVLVSILWIPVVQASQGGQLFIYIQSISSYLQPPVAVVFIMGCFWKRTNEKGAFWGLISGLLLGLVRLVLDFIYVQPRCDQPDERPVLVKSIHYLYFSMILSTVTLITVSTVSWFTEPPSKEMVSHLTWFTRHDPVVQKEQAPPAAPLSLTLSQNGMPEASSSSSVQFEMVQENTSKTHSCDMTPKQSKVVKAILWLCGIQEKGKEELPARAEAIIVSLEENPLVKTLLDVNLIFCVSCAIFIWGYFA

SEQ ID NO: 319 - protein, 674 aa, Oryctolagus cuniculus
MESSTSSPQPPLSDPLDPFPQRSLEPGDIAVLVLYFLFVLAVGLWSTVKTKRDTVKGYFLAGGDMVWWPVGASLFASNVGSGHFVGLAGSGAATGISVAAYEFNGMFSVLMLAWIFLPIYIAGQVTTMPEYLRRRFGGSRIAITLAVLYLFIYIFTKISVDMYTGAIFIQQSLHLDLYLSVVGLLAVTALYTVAGGLAAVIYTDALQTLIMLVGALTLMGYSFAAVGGMEGLQEKYFLALPSNRSENSSCGLPREDAFHLFRDPLTSDLPWPGILFGMSIPSLWYWCTDQVIVQRSLAAKNLSHAKGGSLMAAYLKVLPLFIMVFPGMVSRILFPDQVACADPETCQRVCNNPSGCSDIAYPKLVLELLPTGLRGLMMAVMVAALMSSLTSIFNSASTIFTMDLWNHVRPRASEKELMIVGRVFVLLLVLVSVLWIPVVQASQGGQLFVYIQAISSYLQPPVAMVFVLGCFWKRANEKGAFWGLVLGLLLGFIRLILDFIYVEPACHQPDERPSVVKNVHYLYFSMILSSVTVLTVTVMSLLTEPPSKEMISHLTWFTRRDPVVQKAQVPAATPLPPALSHNGTAEANSASIQLETIQEGASKAHSSDVTPKQSRVVRALLWLCGMEGKSTEQAPRPAEPVLASIEENPVVKTLLDVNCLLCICCAFFLWGYFA

SEQ ID NO: 320 - protein, 548 aa, Homo sapiens
MPEYLRKRFGGIRIPIILAVLYLFIYIFTKISVDMYAGAIFIQQSLHLDLYLAIVGLLAITAVYTVAGGLAAVIYTDALQTLIMLIGALTLMGYSFAAVGGMEGLKEKYFLALASNRSENSSCGLPREDAFHIFRDPLTSDLPWPGVLFGMSIPSLWYWCTDQVIVQRTLAAKNLSHAKGGALMAAYLKVLPLFIMVFPGMVSRILFPDQVACADPEICQKICSNPSGCSDIAYPKLVLELLPTGLRGLMMAVMVAALMSSLTSIFNSASTIFTMDLWNHLRPRASEKELMIVGRVFVLLLVLVSILWIPVVQASQGGQLFIYIQSISSYLQPPVAVVFIMGCFWKRTNEKGAFWGLISGLLLGLVRLVLDFIYVQPRCDQPDERPVLVKSIHYLYFSMILSTVTLITVSTVSWFTEPPSKEMVSHLTWFTRHDPVVQKEQAPPAAPLSLTLSQNGMPEASSSSSVQFEMVQENTSKTHSCDMTPKQSKVVKAILWLCGIQEKGKEELPARAEAIIVSLEENPLVKTLLDVNLIFCVSCAIFIWGYFA

SEQ ID NO: 321 - protein, 673 aa, Homo sapiens
METSSQSSPQTTPGMEAFPKKSLDTIDIVVLVLYFVFVLAVGLLSMCRTKRGTVKGYFLAGKDMAWWPVGASLFASNVGSGHFIGLAGSGAASGIAVTAYEWNGLFCVLALAWLFLPIYISAGVTTMPEYLQRRFGGKRIQIFLAILYLFIYIFTKISVDMYAGALFIQQALQWDLYVAVIGLLVITAIYTVAGGLAAVIYTDTLQTVIMIIGALILMAYSFIEIGGFEALQEKYFHAIPNTHSGNSTCGIPREDAFHIFRDPVTSDLPWPGVLVGMTIPSLWYWCTDQVIVQRSLSAKNLSHAKAGSLLAASLKVLPLFMMVLPGMISRVLFTDQVACADPELCKEICGNPSGCSDIAYPKMVIELLPTGLRGLMMSVMIAALMSSLTSIFNSASTIFTMDLWRHIRPRSTEWELMIVGRVFVLVLVVVSILWIPLVQASQGGQLFIYIQSISSYLQPPVAVVFIAGCFWKRTNEKGAFWGMTIGLVVGLIRMVLDFIYVAPQCDQPDTRPGVVKYVHYLYLSMILGLLTLLVVVAVSLWTEPPSKQMISRLTWFTRFDAEVEDPVETNHRPAENGISVVEDISEEPHTTSTDAIYNDTTDDNPSSSSLLKKTILWLCGMDSRKGDKHDQAPPAPLEPAEVLLYERPLLKQVLNTAVILCMSAGVFLWAYFG

SEQ ID NO: 322 - protein, 318 aa, Homo sapiens; identical to SEQ ID NO: 119

SEQ ID NO: 323 - protein, 318 aa, Homo sapiens
MEWENHTILVEFFLKGLSGHPRLELLFFVLIFIMYVVILLGNGTLILISILDPHLHTPMYFFLGNLSFLDICYTTTSIPSTLVSFLSERKTISLSGCAVQMFLGLAMGTTECVLLGMMAFDRYVAICNPLRYPIIMSKDAYVPMAAGSWIIGAVNSAVQSVFVVQLPFCRNNIINHFTCEILAVMKLACADISDNEFIMLVATTLFILTPLLLIIVSYTLIIVSIFKISSSEGRSKASSTCSAHLTVVIIFYGTILFMYMKPKSKETLNSDDLDATDKIISMFYGVMTPMMNPLIYSLRNKDVKEAVKHLLNRRFFSK

SEQ ID NO: 324 - protein, 318 aa, Homo sapiens
MEWENQTILVEFFLKGHSVHPRLELLFFVLIFIMYVVILLGNGTLILISILDPHLHTPMYFFLGNLSFLDICYTTTSIPSTLVSFLSERKTISFSGCAVQMFLGLAMGTTECVLLGMMAFDRYVAICNPLRYPIIMSKNAYVPMAVGSWFAGIVNSAVQTTFVVQLPFCRKNVINHFSCEILAVMKLACADISGNEFLMLVATILFTLMPLLLIVISYSLIISSILKIHSSEGRSKAFSTCSAHLTVVIIFYGTILFMYMKPKSKETLNSDDLDATDKIISMFYGVMTPMMNPLIYSLRNKDVKEAVKHLPNRRFFSK

SEQ ID NO: 325 - protein, 318 aa, Mus musculus; identical to SEQ ID NO: 220

SEQ ID NO: 326 - protein, 318 aa, Mus musculus; identical to SEQ ID NO: 222

SEQ ID NO: 327 - protein, 254 aa, Artificial Sequence; identical to SEQ ID NO: 248
  Description of Artificial Sequence: 7tm_1, 7 transmembrane receptor domain consensus sequence

SEQ ID NO: 328 - DNA, 21 bp, Artificial Sequence
  Description of Artificial Sequence: PCR Primer sequence
ccttccatacctccccggctc

SEQ ID NO: 329 - DNA, 25 bp, Artificial Sequence
  Description of Artificial Sequence: PCR Primer sequence
tgtgggaaggtctatggcacattga

SEQ ID NO: 330 - protein, 140 aa, Homo sapiens
MAALYRPGLRLNWHGLSPLGWPSCRSIQTLRVLSGDLGQLPTGIRDFVEHSARLCQPEGIHICDGTEAENTATLTLLEQQGLIRKLPKYNNCWLARTDPKDVARVESKTVIVTPSQRDTVQLPPGGARGQLGNWMSPADF

SEQ ID NO: 331 - protein, 140 aa, Homo sapiens
MAALYRPGLRLNWHGLSPLGWPSCRSIQTLRVLSGDLGQLPTGIRDFVEHSARLCQPEGIHICDGTEAENTATLTLLEQQGLIRKLPKYNNCWLARTDPKDVARVESKTVIVTPSQRDTVPLPPGGARGQLGNWMSPADF

SEQ ID NO: 332 - protein, 140 aa, Mus musculus
MAAMYLPGLRLSRHGLRPWCWSPCRSIQTLRVLSGDMSQLPAGVRDFVARSAHLCQPEGIHICDGTEAENTAILALLEEQGLIRKLPKYKNCWLARTDPKDVARVESKTVIVTPSQRDTVPLLAGGARGQLGNWMSPDEF

SEQ ID NO: 333 - protein, 140 aa, Homo sapiens; identical to SEQ ID NO: 331

SEQ ID NO: 334 - protein, 140 aa, Homo sapiens
MAALYRPGLRLNWHGLSPLGWPSCRSIQTLRVLSGDLGQLPTGIRDFVEHSARLCQPEGIHICDGTEAENTATLTLLEQQGLIRKLPKYNNCWLARTDPKDVARVESKTVIVTPSQRDTVPLPPGGACGQLGNWMSPADF

SEQ ID NO: 335 - protein, 342 aa, Homo sapiens
MTETSLSSQCFPMSVLNNTIAEPLIFLLMGIPGLKATQYWISIPFCLLYVVAVSGNSMILFVVLCERSLHKPMYYFLSMLSATDLSLSLCTLSTTLGVFWFEAREINLNACIAQMFFLHGFTFMESGVLLAMAFDRFVAICYPLRYTTILTNARIAKIGMSMLIRNVAVMLPVMLFVKRLSFCSSMVLSHSYCYHVDLIQLSCTDNRINSILGLFALLSTTGFDCPCILLSYILIIRSVLSIASSEERRKAFNTCTSHISAVSIFYLPLISLSLVHRYGHSAPPFVHIIMANVFLLIPPVLNPIIYSVKIKQIQKAIIKVLIQKHSKSNHQLFLIRDKAIYE

SEQ ID NO: 336 - protein, 329 aa, Homo sapiens
QDFGGHPPSPLSPHTMTLGSLGNSSSSVSATFLLSGIPGLERMHIWISIPLCFMYLVSIPGNCTILFIIKTERSLHEPMYLFLSMLALIDLGLSLCTLPTVLGIFWVGAREISHDACFAQLFFIHCFSFLESSVLLSMAFDRFVAICHPLHYVSILTNTVIGRIGLVSLGRSVALIFPLPFMLKRFPYCGSPVLSHSYCLHQEVMKLACADMKANSIYGMFVIVSTVGIDSLLILFSYALILRTVLSIASRAERFKALNTCVSHICAVLLFYTPMIGLSVIHRFGKQAPHLVQVVMGFMYLLFPPVMNPIVYSVKTKQIRDRVTHAFCY

SEQ ID NO: 337 - protein, 327 aa, Homo sapiens
MAIFNNTTSSSSNFLLTAFPGLECAHVWISIPVCCLYTIALLGNSMIFLVIITKRRLHKPMYYFLSMLAAVDLCLTITTLPTVLGVLWFHAREISFKACFIQMFFVHAFSLLESSVLVAMAFDRFVAICNPLNYATILTDRMVLVIGLVICIRPAVFLLPLLVAINTVSFHGGHELSHPFCYHPEVIKYTYSKPWISSFWGLFLQLYLNGTDVLFILFSYVLILRTVLGIVARKKQQKALSTCVCHICAVTIFYVPLISLSLAHRLFHSTPRVLCSTLANIYLLLPPVLNPIIYSLKTKTIRQAMFQLLQSKGSWGFNVRGLRGRWD

SEQ ID NO: 338 - protein, 321 aa, Homo sapiens
MFLSSRMITSVSPSTSTNSSFLLTGFSGMEQQYPWFSIPFSSIYAMVLLGNCMVLHVIWTEPSLHQPMFYFLSMLALTDLCMGLSTVYTVLGILWRIIREISLDSCIAQSYFIHGLSFMESSVLLTMAFDRYIAICNPLRYSSILTNSRIIKIGLTIIGRSFFFITPPIICLKFFNYCHFHILSHSFCLHQDLLRLACSDIRFNSYYALMLVICILLLDAILILFSYILILKSVLAVASQEERHKLFQTCISHICAVLVFYIPIISLTMVHRFGKHLSPVAHVLIGNIYILFPPLMNPIIYSVKTQQIHTRMLRLFSLKRY

SEQ ID NO: 339 - protein, 312 aa, Homo sapiens
MGLFNVTHPAFFLLTGIPGLESSHSWLSGPLCVMYAVALGGNTVILQAVRVEPSLHEPMYYFLSMLSFSDVAISMATLPTVLRTFCLNARNITFDACLIQMFLIHFFSMMESGILLAMSFDRYVAICDPLRYATVLTTEVIAAMGLGAAARSFITLFPLPFLIKRLPICRSNVLSHSYCLHPDMMRLACADISINSIYGLFVLVSTFGMDLFFIFLSYVLILRSVMATASREERLKALNTCVSHILAVLAFYVPMIGVSTVHRFGKHVPCYIHVLMSNVYLFVPPVLNPLIYSAKTKEIRRAIFRMFHHIKI

SEQ ID NO: 340 - protein, 254 aa, Artificial Sequence; identical to SEQ ID NO: 248
  Description of Artificial Sequence: 7tm_1, 7 transmembrane receptor domain consensus sequence

SEQ ID NO: 341 - DNA, 20 bp, Artificial Sequence
  Description of Artificial Sequence: PCR Primer sequence
gactgctgtggacttggttg

SEQ ID NO: 342 - DNA, 23 bp, Artificial Sequence
  Description of Artificial Sequence: PCR Primer sequence
gaggtggaggtgttgggcgaggt

SEQ ID NO: 343 - DNA, 20 bp, Artificial Sequence
  Description of Artificial Sequence: PCR Primer sequence
aaagaagtgttggtggaggg

SEQ ID NO: 344 - DNA, 20 bp, Artificial Sequence
  Description of Artificial Sequence: PCR Primer sequence
ccttaggaccctctggtgtt

SEQ ID NO: 345 - DNA, 26 bp, Artificial Sequence
  Description of Artificial Sequence: PCR Primer sequence
caacttattgaatttaatcccagcca

SEQ ID NO: 346 - DNA, 20 bp, Artificial Sequence
  Description of Artificial Sequence: PCR Primer sequence
tagttggcacagcactttga

SEQ ID NO: 347 - DNA, 22 bp, Artificial Sequence
  Description of Artificial Sequence: PCR Primer sequence
gccttatcaatgctaccaacag

SEQ ID NO: 348 - DNA, 24 bp, Artificial Sequence
  Description of Artificial Sequence: PCR Primer sequence
ctgcagatgccactccacattgct

SEQ ID NO: 349 - DNA, 22 bp, Artificial Sequence
  Description of Artificial Sequence: PCR Primer sequence
gcctgtaccacagaagctagac

SEQ ID NO: 350 - DNA, 20 bp, Artificial Sequence
  Description of Artificial Sequence: PCR Primer sequence
agcttagcctcagcgagttc

SEQ ID NO: 351 - DNA, 26 bp, Artificial Sequence
  Description of Artificial Sequence: PCR Primer sequence
ctgctactcttcaccactgctggcat

SEQ ID NO: 352 - DNA, 22 bp, Artificial Sequence
  Description of Artificial Sequence: PCR Primer sequence
gttctcgctgaacagagacttg

SEQ ID NO: 353 - DNA, 22 bp, Artificial Sequence
  Description of Artificial Sequence: PCR Primer sequence
tcagcaatctccaattgagatt

SEQ ID NO: 354 - DNA, 26 bp, Artificial Sequence
  Description of Artificial Sequence: PCR Primer sequence
tgaaatatgactcttccctccgacca

SEQ ID NO: 355 - DNA, 22 bp, Artificial Sequence
  Description of Artificial Sequence: PCR Primer sequence
ttttagctgagcttgggtcata

SEQ ID NO: 356 - DNA, 22 bp, Artificial Sequence
  Description of Artificial Sequence: PCR Primer sequence
tcagcaatctccaattgagatt

SEQ ID NO: 357 - DNA, 26 bp, Artificial Sequence
  Description of Artificial Sequence: PCR Primer sequence
tgaaatatgactcttccctccgacca

SEQ ID NO: 358 - DNA, 22 bp, Artificial Sequence
  Description of Artificial Sequence: PCR Primer sequence
ttttagctgagcttgggtcata

SEQ ID NO: 359 - DNA, 22 bp, Artificial Sequence
  Description of Artificial Sequence: PCR Primer sequence
catcagggtcttcaagagattg

SEQ ID NO: 360 - DNA, 26 bp, Artificial Sequence
  Description of Artificial Sequence: PCR Primer sequence
ccgagacattgggattcccttctcat

SEQ ID NO: 361 - DNA, 22 bp, Artificial Sequence
  Description of Artificial Sequence: PCR Primer sequence
acaaacccatatgttccactgt

SEQ ID NO: 362 - DNA, 22 bp, Artificial Sequence
  Description of Artificial Sequence: PCR Primer sequence
acagtggaacatatgggtttgt

SEQ ID NO: 363 - DNA, 25 bp, Artificial Sequence
  Description of Artificial Sequence: PCR Primer sequence
agaagctcagatccagcccacctgt

SEQ ID NO: 364 - DNA, 22 bp, Artificial Sequence
  Description of Artificial Sequence: PCR Primer sequence
catacacatcatccaggactga

SEQ ID NO: 365 - DNA, 23 bp, Artificial Sequence
  Description of Artificial Sequence: PCR Primer sequence
gcttcttggtgtaattcaagttg

SEQ ID NO: 366 - DNA, 26 bp, Artificial Sequence
  Description of Artificial Sequence: PCR Primer sequence
acagaaggcagcaaatgcattgaaag

SEQ ID NO: 367 - DNA, 26 bp, Artificial Sequence
  Description of Artificial Sequence: PCR Primer sequence
ccaactctataattggttccatactt

SEQ ID NO: 368 - DNA, 22 bp, Artificial Sequence
  Description of Artificial Sequence: PCR Primer sequence
catcagggtcttcaagagattg

SEQ ID NO: 369 - DNA, 26 bp, Artificial Sequence
  Description of Artificial Sequence: PCR Primer sequence
ccgagacattgggattcccttctcat

SEQ ID NO: 370 - DNA, 22 bp, Artificial Sequence
  Description of Artificial Sequence: PCR Primer sequence
acaaacccatatgttccactgt

SEQ ID NO: 371 - DNA, 21 bp, Artificial Sequence
  Description of Artificial Sequence: PCR Primer sequence
gttgatcgtcttcacggaaag

SEQ ID NO: 372 - DNA, 23 bp, Artificial Sequence
  Description of Artificial Sequence: PCR Primer sequence
cctaccacatgttggccagggtg

SEQ ID NO: 373 - DNA, 24 bp, Artificial Sequence
  Description of Artificial Sequence: PCR Primer sequence
aagtgttttctctttcactgcttg

SEQ ID NO: 374 - DNA, 22 bp, Artificial Sequence
  Description of Artificial Sequence: PCR Primer sequence
acagtggaacatatgggtttgt

SEQ ID NO: 375 - DNA, 25 bp, Artificial Sequence
  Description of Artificial Sequence: PCR Primer sequence
agaagctcagatccagcccacctgt

SEQ ID NO: 376 - DNA, 22 bp, Artificial Sequence
  Description of Artificial Sequence: PCR Primer sequence
catacacatcatccaggactga

SEQ ID NO: 377 - DNA, 20 bp, Artificial Sequence
  Description of Artificial Sequence: PCR Primer sequence
agaagtgccaactccagagc

SEQ ID NO: 378 - DNA, 25 bp, Artificial Sequence
  Description of Artificial Sequence: PCR Primer sequence
aggtggagcagctgaagctggaggt

SEQ ID NO: 379 - DNA, 20 bp, Artificial Sequence
  Description of Artificial Sequence: PCR Primer sequence
cttgtacaggtcccgctctt

SEQ ID NO: 380 - DNA, 22 bp, Artificial Sequence
  Description of Artificial Sequence: PCR Primer sequence
cattgaggtcttcacccactac

SEQ ID NO: 381 - DNA, 26 bp, Artificial Sequence
  Description of Artificial Sequence: PCR Primer sequence
ctcctcactctcaatggctccaaggt

SEQ ID NO: 382 - DNA, 22 bp, Artificial Sequence
  Description of Artificial Sequence: PCR Primer sequence
gtttgtgtcctccagacagaag

SEQ ID NO: 383 - DNA, 22 bp, Artificial Sequence
  Description of Artificial Sequence: PCR Primer sequence
cattgaggtcttcacccactac

SEQ ID NO: 384 - DNA, 26 bp, Artificial Sequence
  Description of Artificial Sequence: PCR Primer sequence
ctcctcactctcaatggctccaaggt

SEQ ID NO: 385 - DNA, 22 bp, Artificial Sequence
  Description of Artificial Sequence: PCR Primer sequence
gtttgtgtcctccagacagaag

SEQ ID NO: 386 - DNA, 20 bp, Artificial Sequence
  Description of Artificial Sequence: PCR Primer sequence
ctatctagggacggcaggat

SEQ ID NO: 387 - DNA, 25 bp, Artificial Sequence
  Description of Artificial Sequence: PCR Primer sequence
ctcctgaccttcgacttcgacgaga

SEQ ID NO: 388 - DNA, 20 bp, Artificial Sequence
  Description of Artificial Sequence: PCR Primer sequence
gctgttttcgtccacgatag

SEQ ID NO: 389 - DNA, 20 bp, Artificial Sequence
  Description of Artificial Sequence: PCR Primer sequence
ctgcttctgtcaggaaagca

SEQ ID NO: 390 - DNA, 25 bp, Artificial Sequence
  Description of Artificial Sequence: PCR Primer sequence
tttctggtcttcctgcctcggaact

SEQ ID NO: 391 - DNA, 22 bp, Artificial Sequence
  Description of Artificial Sequence: PCR Primer sequence
tgtggtttgttattgcagtgtt

SEQ ID NO: 392 - DNA, 19 bp, Artificial Sequence
  Description of Artificial Sequence: PCR Primer sequence
gagctgccgcaactcttcc

SEQ ID NO: 393 - DNA, 25 bp, Artificial Sequence
  Description of Artificial Sequence: PCR Primer sequence
cgcaactctgcctcttcctcatcgg

SEQ ID NO: 394 - DNA, 24 bp, Artificial Sequence
  Description of Artificial Sequence: PCR Primer sequence
gacaaacttctctgtgagcgtgtg

SEQ ID NO: 395 - DNA, 22 bp, Artificial Sequence
  Description of Artificial Sequence: PCR Primer sequence
aactcttccaggatgacgacgt

SEQ ID NO: 396 - DNA, 25 bp, Artificial Sequence
  Description of Artificial Sequence: PCR Primer sequence
cgcaactctgcctcttcctcatcgg

SEQ ID NO: 397 - DNA, 22 bp, Artificial Sequence
  Description of Artificial Sequence: PCR Primer sequence
cttctctgtgagcgtgtgttcg

SEQ ID NO: 398 - DNA, 20 bp, Artificial Sequence
  Description of Artificial Sequence: PCR Primer sequence
tgaacaccccaggctcctac

SEQ ID NO: 399 - DNA, 22 bp, Artificial Sequence
  Description of Artificial Sequence: PCR Primer sequence
cggcttccggctccacactgac

SEQ ID NO: 400 - DNA, 19 bp, Artificial Sequence
  Description of Artificial Sequence: PCR Primer sequence
taatggccaggcaggtcct

SEQ ID NO: 401 - DNA, 22 bp, Artificial Sequence
  Description of Artificial Sequence: PCR Primer sequence
acacacgctcacagagaagttt

SEQ ID NO: 402 - DNA, 25 bp, Artificial Sequence
  Description of Artificial Sequence: PCR Primer sequence
ctggatgactcctttggccatgact

SEQ ID NO: 403 - DNA, 21 bp, Artificial Sequence
  Description of Artificial Sequence: PCR Primer sequence
ctgcagtcatcacaggtcaag

SEQ ID NO: 404 - DNA, 21 bp, Artificial Sequence
  Description of Artificial Sequence: PCR Primer sequence
ctgcagtcatcacaggtcaag

SEQ ID NO: 405 - DNA, 26 bp, Artificial Sequence
  Description of Artificial Sequence: PCR Primer sequence
ccaaaggagtcatccaggcagacaaa

SEQ ID NO: 406 - DNA, 21 bp, Artificial Sequence
  Description of Artificial Sequence: PCR Primer sequence
gaacacacgctcacagagaag

SEQ ID NO: 407 - DNA, 22 bp, Artificial Sequence
  Description of Artificial Sequence: PCR Primer sequence
ttaattgtgctgagggaagaaa

SEQ ID NO: 408 - DNA, 26 bp, Artificial Sequence
  Description of Artificial Sequence: PCR Primer sequence
cttctctacctgttcagcgcactcga

SEQ ID NO: 409 - DNA, 22 bp, Artificial Sequence
  Description of Artificial Sequence: PCR Primer sequence
aagggctgaaccgtagaataag

SEQ ID NO: 410 - DNA, 22 bp, Artificial Sequence
  Description of Artificial Sequence: PCR Primer sequence
ttattctacggttcagcccttt

SEQ ID NO: 411 - DNA, 27 bp, Artificial Sequence
  Description of Artificial Sequence: PCR Primer sequence
tgtacatgaaacccaagtcaaagaaca

SEQ ID NO: 412 - DNA, 22 bp, Artificial Sequence
  Description of Artificial Sequence: PCR Primer sequence
cactccataagacagcccaata

SEQ ID NO: 413 - DNA, 22 bp, Artificial Sequence
  Description of Artificial Sequence: PCR Primer sequence
ttaattgtgctgagggaagaaa

SEQ ID NO: 414 - DNA, 26 bp, Artificial Sequence
  Description of Artificial Sequence: PCR Primer sequence
cttctctacctgttcagcgcactcga

SEQ ID NO: 415 - DNA, 22 bp, Artificial Sequence
  Description of Artificial Sequence: PCR Primer sequence
aagggctgaaccgtagaataag

SEQ ID NO: 416 - DNA, 22 bp, Artificial Sequence
  Description of Artificial Sequence: PCR Primer sequence
agcattactgccaaagtttgaa

SEQ ID NO: 417 - DNA, 26 bp, Artificial Sequence
  Description of Artificial Sequence: PCR Primer sequence
cctcgtagtcctgcccagatcttgat

SEQ ID NO: 418 - DNA, 22 bp, Artificial Sequence
  Description of Artificial Sequence: PCR Primer sequence
cccctctttcctcactctctaa

SEQ ID NO: 419 - DNA, 21 bp, Artificial Sequence
  Description of Artificial Sequence: PCR Primer sequence
ctgctgatgaggggctactac

SEQ ID NO: 420 - DNA, 26 bp, Artificial Sequence
  Description of Artificial Sequence: PCR Primer sequence
aacctcaaccccaacgacagcattgt

SEQ ID NO: 421 - DNA, 21 bp, Artificial Sequence
  Description of Artificial Sequence: PCR Primer sequence
gaacttcatctggcaggagtt

SEQ ID NO: 422 - DNA, 21 bp, Artificial Sequence
  Description of Artificial Sequence: PCR Primer sequence
gaccaattcattgggctctat

SEQ ID NO: 423 - DNA, 26 bp, Artificial Sequence
  Description of Artificial Sequence: PCR Primer sequence
ctattattcgcagggacttctgcgct

SEQ ID NO: 424 - DNA, 19 bp, Artificial Sequence
  Description of Artificial Sequence: PCR Primer sequence
atgacgttcccgcctattt

SEQ ID NO: 425 - DNA, 22 bp, Artificial Sequence
  Description of Artificial Sequence: PCR Primer sequence
attctgttagacatggcttgca

SEQ ID NO: 426 - DNA, 24 bp, Artificial Sequence
  Description of Artificial Sequence: PCR Primer sequence
cctcactcaccgcttgagtcttgg

SEQ ID NO: 427 - DNA, 22 bp, Artificial Sequence
  Description of Artificial Sequence: PCR Primer sequence
ctgtattccacttctgaggacc

SEQ ID NO: 428 - DNA, 18 bp, Artificial Sequence
  Description of Artificial Sequence: PCR Primer sequence
aacctcgtgcccgtctgc

SEQ ID NO: 429 - DNA, 27 bp, Artificial Sequence
  Description of Artificial Sequence: PCR Primer sequence
ctgtcctgtgtttgaatgtggcaacgt

SEQ ID NO: 430 - DNA, 20 bp, Artificial Sequence
  Description of Artificial Sequence: PCR Primer sequence
attcacatccctttcatcag

SEQ ID NO: 431 - DNA, 22 bp, Artificial Sequence
  Description of Artificial Sequence: PCR Primer sequence
aaatgcagtagcagagggaatt

SEQ ID NO: 432 - DNA, 29 bp, Artificial Sequence
  Description of Artificial Sequence: PCR Primer sequence
cgctcagaagaaaacatctataccattga

SEQ ID NO: 433 - DNA, 22 bp, Artificial Sequence
  Description of Artificial Sequence: PCR Primer sequence
ggctcctccacttcatatacgt

SEQ ID NO: 434 - DNA, 21 bp, Artificial Sequence
  Description of Artificial Sequence: PCR Primer sequence
ctctattcttggtggcttcca

SEQ ID NO: 435 - DNA, 25 bp, Artificial Sequence
  Description of Artificial Sequence: PCR Primer sequence
ctcctgcatggcaagtcccagttag

SEQ ID NO: 436 - DNA, 22 bp, Artificial Sequence
  Description of Artificial Sequence: PCR Primer sequence
ccaccttctgcagattctgtac

SEQ ID NO: 437 - DNA, 22 bp, Artificial Sequence
  Description of Artificial Sequence: PCR Primer sequence
ccaactcaatcttggacctctt

SEQ ID NO: 438 - DNA, 26 bp, Artificial Sequence
  Description of Artificial Sequence: PCR Primer sequence
atccgcaaggtcacatgctgtctcat

SEQ ID NO: 439 - DNA, 22 bp, Artificial Sequence
  Description of Artificial Sequence: PCR Primer sequence
cagagttggagaaccaaatcac

SEQ ID NO: 440 - DNA, 22 bp, Artificial Sequence
  Description of Artificial Sequence: PCR Primer sequence
ccaactcaatcttggacctctt

SEQ ID NO: 441 - DNA, 26 bp, Artificial Sequence
  Description of Artificial Sequence: PCR Primer sequence
atccgcaaggtcacatgctgtctcat

SEQ ID NO: 442 - DNA, 22 bp, Artificial Sequence
  Description of Artificial Sequence: PCR Primer sequence
cagagttggagaaccaaatcac

SEQ ID NO: 443 - DNA, 21 bp, Artificial Sequence
  Description of Artificial Sequence: PCR Primer sequence
cgctgtcctgctagtcttgtt

SEQ ID NO: 444 - DNA, 26 bp, Artificial Sequence
  Description of Artificial Sequence: PCR Primer sequence
atatcaagaacctgcctgcccaggct

SEQ ID NO: 445 - DNA, 20 bp, Artificial Sequence
  Description of Artificial Sequence: PCR Primer sequence
ccttcacctctggacatgtg

SEQ ID NO: 446 - DNA, 19 bp, Artificial Sequence
  Description of Artificial Sequence: PCR Primer sequence
cagctggggggtaattctc

SEQ ID NO: 447 - DNA, 29 bp, Artificial Sequence
  Description of Artificial Sequence: PCR Primer sequence
caacttcttctccaccaaagaccaagaca

SEQ ID NO: 448 - DNA, 22 bp, Artificial Sequence
  Description of Artificial Sequence: PCR Primer sequence
gcacaattcgaagaactcacat

SEQ ID NO: 449 - DNA, 21 bp, Artificial Sequence
  Description of Artificial Sequence: PCR Primer sequence
cgctgtcctgctagtcttgtt

SEQ ID NO: 450 - DNA, 26 bp, Artificial Sequence
  Description of Artificial Sequence: PCR Primer sequence
atatcaagaacctgcctgcccaggct

SEQ ID NO: 451 - DNA, 20 bp, Artificial Sequence
  Description of Artificial Sequence: PCR Primer sequence
ccttcacctctggacatgtg

SEQ ID NO: 452 - DNA, 22 bp, Artificial Sequence
  Description of Artificial Sequence: PCR Primer sequence
gtcagcttctcttgctttgaga

SEQ ID NO: 453 - DNA, 23 bp, Artificial Sequence
  Description of Artificial Sequence: PCR Primer sequence
cactgtcaggcactcgccaatgt

SEQ ID NO: 454 - DNA, 22 bp, Artificial Sequence
  Description of Artificial Sequence: PCR Primer sequence
ctgtatttctggaagcattcca

SEQ ID NO: 455 - DNA, 22 bp, Artificial Sequence
  Description of Artificial Sequence: PCR Primer sequence
ttgatgtctctgagatccaaca

SEQ ID NO: 456 - DNA, 26 bp, Artificial Sequence
  Description of Artificial Sequence: PCR Primer sequence
agtttccgagctctgggcatttccat

SEQ ID NO: 457 - DNA, 21 bp, Artificial Sequence
  Description of Artificial Sequence: PCR Primer sequence
catgctgtgcaaaattttctc

SEQ ID NO: 458 - DNA, 21 bp, Artificial Sequence
  Description of Artificial Sequence: PCR Primer sequence
ttggtcatagtggcactcatc

SEQ ID NO: 459 - DNA, 25 bp, Artificial Sequence
  Description of Artificial Sequence: PCR Primer sequence
aggactccaacagcgggcaactctt

SEQ ID NO: 460 - DNA, 22 bp, Artificial Sequence
  Description of Artificial Sequence: PCR Primer sequence
ggtcactgactgcatgtagatg

SEQ ID NO: 461 - DNA, 20 bp, Artificial Sequence
  Description of Artificial Sequence: PCR Primer sequence
agcgggcaactcttcatcta

SEQ ID NO: 462 - DNA, 24 bp, Artificial Sequence
  Description of Artificial Sequence: PCR Primer sequence
atgcagtcagtgaccagctccctg

SEQ ID NO: 463 - DNA, 22 bp, Artificial Sequence
  Description of Artificial Sequence: PCR Primer sequence
caggacaaagactgcagtcact

SEQ ID NO: 464 - DNA, 22 bp, Artificial Sequence
  Description of Artificial Sequence: PCR Primer sequence
cagaggatccaggtgtacatgt

SEQ ID NO: 465 - DNA, 27 bp, Artificial Sequence
  Description of Artificial Sequence: PCR Primer sequence
tcctctacatcttcaccaagatctcgg

SEQ ID NO: 466 - DNA, 22 bp, Artificial Sequence
  Description of Artificial Sequence: PCR Primer sequence
agggctccagagaagatgtcta

SEQ ID NO: 467 - DNA, 16 bp, Artificial Sequence
  Description of Artificial Sequence: PCR Primer sequence
tcgtccatccgtgcaa

SEQ ID NO: 468 - DNA, 20 bp, Artificial Sequence
  Description of Artificial Sequence: PCR Primer sequence
cgagggaccattggcggcta

SEQ ID NO: 469 - DNA, 14 bp, Artificial Sequence
  Description of Artificial Sequence: PCR Primer sequence
gggtggggccagga

SEQ ID NO: 470 - DNA, 23 bp, Artificial Sequence
  Description of Artificial Sequence: PCR Primer sequence
caggtctcttatttctctgttcg

SEQ ID NO: 471 - DNA, 21 bp, Artificial Sequence
  Description of Artificial Sequence: PCR Primer sequence
cctcccacagcacagcactgc

SEQ ID NO: 472 - DNA, 15 bp, Artificial Sequence
  Description of Artificial Sequence: PCR Primer sequence
acagaggggcggctt

SEQ ID NO: 473 - DNA, 21 bp, Artificial Sequence
  Description of Artificial Sequence: PCR Primer sequence
tcaaggtctggaggagacaga

SEQ ID NO: 474 - DNA, 22 bp, Artificial Sequence
  Description of Artificial Sequence: PCR Primer sequence
ccatccaaggtcacacgggagg

SEQ ID NO: 475 - DNA, 17 bp, Artificial Sequence
  Description of Artificial Sequence: PCR Primer sequence
caggttgcctgggacct

SEQ ID NO: 476 - DNA, 22 bp, Artificial Sequence
  Description of Artificial Sequence: PCR Primer sequence
ctccctcacctccatctttaac

SEQ ID NO: 477 - DNA, 26 bp, Artificial Sequence
  Description of Artificial Sequence: PCR Primer sequence
ccatcttcaccatggacctctggaat

SEQ ID NO: 478 - DNA, 22 bp, Artificial Sequence
  Description of Artificial Sequence: PCR Primer sequence
atcatgagctccttctcagatg

SEQ ID NO: 479 - DNA, 22 bp, Artificial Sequence
  Description of Artificial Sequence: PCR Primer sequence
ctcaccttcacacccctatgta

SEQ ID NO: 480 - DNA, 26 bp, Artificial Sequence
  Description of Artificial Sequence: PCR Primer sequence
ctttctggggaacctctccttcttgg

SEQ ID NO: 481 - DNA, 22 bp, Artificial Sequence
  Description of Artificial Sequence: PCR Primer sequence
gaatagaggtggtggtgtagca

SEQ ID NO: 482 - DNA, 22 bp, Artificial Sequence
  Description of Artificial Sequence: PCR Primer sequence
tgataacattctgtgggaccat

SEQ ID NO: 483 - DNA, 27 bp, Artificial Sequence
  Description of Artificial Sequence: PCR Primer sequence
cctcatgtacatgaagcccaagtctca

SEQ ID NO: 484 - DNA, 22 bp, Artificial Sequence
  Description of Artificial Sequence: PCR Primer sequence
ggcatccaagtcatctgaatta

SEQ ID NO: 485 - DNA, 22 bp, Artificial Sequence
  Description of Artificial Sequence: PCR Primer sequence
ctcaccttcacacccctatgta

SEQ ID NO: 486 - DNA, 26 bp, Artificial Sequence
  Description of Artificial Sequence: PCR Primer sequence
ctttctggggaacctctccttcttgg

SEQ ID NO: 487 - DNA, 22 bp, Artificial Sequence
  Description of Artificial Sequence: PCR Primer sequence
gaatagaggtggtggtgtagca

SEQ ID NO: 488 - DNA, 15 bp, Artificial Sequence
  Description of Artificial Sequence: PCR Primer sequence
ctgggaggccccaga

SEQ ID NO: 489 - DNA, 22 bp, Artificial Sequence
  Description of Artificial Sequence: PCR Primer sequence
tgtccccattgacgccatcatc

SEQ ID NO: 490 - DNA, 21 bp, Artificial Sequence
  Description of Artificial Sequence: PCR Primer sequence
gatgatcttccctttgggtct

SEQ ID NO: 491 - DNA, 36 bp, Artificial Sequence
  Description of Artificial Sequence: PCR Primer sequence
agatctaagggccggaccgcactcttcctggccacg

SEQ ID NO: 492 - DNA, 36 bp, Artificial Sequence
  Description of Artificial Sequence: PCR Primer sequence
ctcgagttcatccacagccagcactgtggccccatg

SEQ ID NO: 493 - DNA, 17 bp, Artificial Sequence
  Description of Artificial Sequence: PCR Primer sequence
catggagcggcggctgc

SEQ ID NO: 494 - DNA, 25 bp, Artificial Sequence
  Description of Artificial Sequence: PCR Primer sequence
gcacaaaagggtccttcagcatctc

SEQ ID NO: 495 - DNA, 22 bp, Artificial Sequence
  Description of Artificial Sequence: PCR Primer sequence
ctccaacatggcaaaaatctcc

SEQ ID NO: 496 - DNA, 22 bp, Artificial Sequence
  Description of Artificial Sequence: PCR Primer sequence
caaggggtcctcagttccactt

SEQ ID NO: 497 - DNA, 24 bp, Artificial Sequence
  Description of Artificial Sequence: PCR Primer sequence
atgtcgaggctcagctggggatac

SEQ ID NO: 498 - DNA, 27 bp, Artificial Sequence
  Description of Artificial Sequence: PCR Primer sequence
gggggagttcattggtgacaattttta

SEQ ID NO: 499 - DNA, 27 bp, Artificial Sequence
  Description of Artificial Sequence: PCR Primer sequence
gatgcattcattctcaaggacacttga

SEQ ID NO: 500 - DNA, 27 bp, Artificial Sequence
  Description of Artificial Sequence: PCR Primer sequence
cctgggcagaatgcacttagagaagag

SEQ ID NO: 501 - DNA, 20 bp, Artificial Sequence
  Description of Artificial Sequence: PCR Primer sequence
caatggtgaacaatttctcc

SEQ ID NO: 502 - DNA, 25 bp, Artificial Sequence
  Description of Artificial Sequence: PCR Primer sequence
tcaagttagttttgaggtctctaca

SEQ ID NO: 503 - DNA, 21 bp, Artificial Sequence
  Description of Artificial Sequence: PCR Primer sequence
cgcgctccatctggtatcttg

SEQ ID NO: 504 - DNA, 27 bp, Artificial Sequence
  Description of Artificial Sequence: PCR Primer sequence
tgactgggtttccttacagaagaggag

SEQ ID NO: 505 - DNA, 23 bp, Artificial Sequence
  Description of Artificial Sequence: PCR Primer sequence
ggaggccaacagagtccctacag

SEQ ID NO: 506 - DNA, 27 bp, Artificial Sequence
  Description of Artificial Sequence: PCR Primer sequence
caaagggaaaagggagtagtaaagctg

SEQ ID NO: 507 - DNA, 22 bp, Artificial Sequence
  Description of Artificial Sequence: PCR Primer sequence
gggcctgatggaggagtttgtg

SEQ ID NO: 508 - DNA, 22 bp, Artificial Sequence
  Description of Artificial Sequence: PCR Primer sequence
atcttgctgggccggctcactt

SEQ ID NO: 509 - DNA, 26 bp, Artificial Sequence
  Description of Artificial Sequence: PCR Primer sequence
catggagacaagaaattactctgcca

SEQ ID NO: 510 - DNA, 26 bp, Artificial Sequence
  Description of Artificial Sequence: PCR Primer sequence
aagctctcttgccccattgaggatat

SEQ ID NO: 511 - DNA, 20 bp, Artificial Sequence
  Description of Artificial Sequence: PCR Primer sequence
gaggcggctgtcgagaaggt

SEQ ID NO: 512 - DNA, 34 bp, Artificial Sequence
  Description of Artificial Sequence: PCR Primer sequence
ataatagagtcagattctttcttgaacattccag

What is claimed is:

1. An isolated nucleic acid molecule comprising a nucleic acid sequence encoding a polypeptide selected from the group consisting of:
   (a) a mature form of an amino acid sequence of SEQ ID NO: 54;
   (b) an amino acid sequence SEQ ID NO: 54.

2. The nucleic acid molecule of claim 1, wherein the nucleic acid molecule comprises a nucleotides 1–4734 of SEQ ID NO: 53.

3. An isolated nucleic acid molecule comprising a nucleic acid sequence that is complementary to said nucleic acid sequence of claim 1.

4. A vector comprising the nucleic acid molecule of claim 1.

5. The vector of claim 4, further comprising a promoter operably-linked to said nucleic acid molecule.

6. A cell comprising the vector of claim 4.

7. A composition comprising the nucleic acid molecule of claim 1.

* * * * *